US 8,460,672 B1

(12) United States Patent
Yusim et al.

(10) Patent No.: US 8,460,672 B1
(45) Date of Patent: Jun. 11, 2013

(54) MOSAIC PROTEIN AND NUCLEIC ACID VACCINES AGAINST HEPATITIS C VIRUS

(75) Inventors: Karina Yusim, Santa Fe, NM (US); Bette T. M. Korber, Los Alamos, NM (US); Carla L. Kuiken, Santa Fe, NM (US); William M. Fischer, Santa Fe, NM (US)

(73) Assignee: Los Alamos National Security, LLC, Los Alamos, NM (US)

( * ) Notice: Subject to any disclaimer, the term of this patent is extended or adjusted under 35 U.S.C. 154(b) by 298 days.

(21) Appl. No.: 12/893,731

(22) Filed: Sep. 29, 2010

Related U.S. Application Data

(60) Provisional application No. 61/246,857, filed on Sep. 29, 2009.

(51) Int. Cl.
| | | |
|---|---|---|
| *A61K 39/00* | (2006.01) | |
| *A61K 39/12* | (2006.01) | |
| *A61K 39/29* | (2006.01) | |

(52) U.S. Cl.
USPC .................. 424/185.1; 424/186.1; 424/189.1; 424/204.1; 424/225.1

(58) Field of Classification Search
USPC ........... 424/185.1, 186.1, 189.1, 204.1, 225.1
See application file for complete search history.

(56) References Cited

PUBLICATIONS

Fischer et al. (Nature Medicine. 2007; 13 (1): 100-106).*
Yusim et al. (Journal of General Virology. 2010; 91 (5): 1194-1206).*
Yusim et al. (Vaccine Immunology. 2012: published online ahead of print on Dec. 5, 2012; Clin. Vaccine Immunol. doi:10.1128/CVI. 00605-12).*

* cited by examiner

*Primary Examiner* — Shanon A Foley
(74) *Attorney, Agent, or Firm* — Klarquist Sparkman, LLP

(57) ABSTRACT

The invention relates to immunogenic compositions useful as HCV vaccines. Provided are HCV mosaic polypeptide and nucleic acid compositions which provide higher levels of T-cell epitope coverage while minimizing the occurrence of unnatural and rare epitopes compared to natural HCV polypeptides and consensus HCV sequences.

5 Claims, 8 Drawing Sheets

MOSAIC PROTEIN AND NUCLEIC ACID VACCINES AGAINST HEPATITIS C VIRUS

RELATED APPLICATIONS

This patent application claims the benefit of the filing date of U.S. Provisional patent application No. 61/246,857 under 35 U.S.C. 119(e).

STATEMENT AS TO RIGHTS AND INVENTIONS MADE UNDER FEDERALLY SPONSORED RESEARCH OR DEVELOPMENT

This invention was made with government support under Contract No. DE-AC52-06 NA 25396 awarded by the U.S. Department of Energy. The government has certain rights in the invention.

BACKGROUND OF THE INVENTION

The hepatitis C virus (HCV) is now recognized as the major agent of chronic hepatitis and liver disease worldwide. It has been estimated that HCV infects about 400 million people worldwide, corresponding to more than 3% of the world population. In the United States alone, the economic burden resulting from HCV infections is predicted to reach many billions of dollars in direct medical costs. HCV infection results in chronic infection in between 70 and 80% of cases, which often progresses to liver cirrhosis, liver failure and/or hepatocellular carcinoma.

HCV is a small enveloped flavivirus, which contains a positive-stranded RNA genome of about 10 kilobases. The genome has a single uninterrupted ORF that encodes a polyprotein of 3010-3011 amino acids in length. The structural proteins of HCV include a core protein (C), which is highly immunogenic, as well as two envelope proteins (E1 and E2), and four non-structural proteins NS2, NS3, NS-4 and NS5. It is known that the NS3 region of the virus is important for post-translational processing of the polyprotein into individual proteins, and that the NS5 region encodes an RNA-dependant RNA polymerase.

Treatment options for HCV infected individuals have significantly improved in recent years with the availability of two therapeutics, a pegylated interferon-α and the nucleoside analogue ribavirin[6-9]. By itself, ribavirin has little effect on HCV, but co-administration with interferon increases the sustained response rate by two- to three-fold. For these reasons, combination therapy is now recommended for hepatitis C, and interferon monotherapy is applied only when there are specific reasons not to use ribavirin.

Unfortunately, these therapies are expensive and require sophisticated medical management, factors which put this option out of reach for the vast majority of infected individuals. Accordingly, the development of a prophylactic vaccine to prevent the continued spread of HCV infection remains critical. Despite over 20 years of vaccine research in numerous laboratories around the world, there is still no HCV vaccine available today.

Nevertheless, several findings indicate that immunological control of HCV is possible. In both humans and chimpanzees, spontaneous eradication of HCV can be achieved during acute infection[10-14]. In addition, re-infection after initial clearance has been shown to lead to a shorter duration and lower peak viremia in the chimpanzee model[15]; this was also correlated with a resurgence of preexisting HCV-specific cytotoxic T-lymphocytes (CTL). Also, injection drug users with ongoing exposure who previously cleared HCV spontaneously were shown to be less likely to develop chronic HCV infection compared to those with no previous infection[16].

Since the isolation of HCV in 1988[17], a number of studies have dissected the roles of different components of protective immunity to HCV[18]. While the function of humoral immune responses against HCV antigens in viral clearance and protection against reinfection is controversial, that of cellular immune responses to HCV is better understood. Virus-specific T lymphocytes, along with neutralizing antibodies, are the principal antiviral immune defense in established viral infections. Control of acute viral replication is clearly associated with expansion of CD4+ and CD8+ T cells[18]. Whereas CD8$^+$ cytotoxic T cells eliminate virus-infected-cells, CD4$^+$ T cells are essential for the efficient regulation of the antiviral immune response. CD4$^+$ T cells recognize specific antigens as peptides bound to autologous HLA class II molecules. Several observations support an important role of CD4$^+$ T cells in the elimination of HCV infection (Tsai et al., 1997, Hepatology 25: 449-458; Diepolder et al., 1995, Lancet 346: 1006-1009; Diepolder et al., 1997, J. Virol. 71: 6011). In a cohort of patients 20 years after exposure to HCV, about 40% of recovered patients had no detectable antibody response, whereas HCV-specific helper and CTL responses persisted[19]. HCV-specific neutralizing antibodies were readily detected in patients with chronic infection and impaired virus-specific CD4$^+$ T-cell response, but not in patients who cleared infection with robust virus-specific CD4$^+$ T-cell response[20]. Vigorous, multispecific CTL and T-helper immune responses against HCV antigens in early infection correlate with clearance of HCV infection[10, 13, 21-26] and HCV-specific CTLs can persist for years after infection[10, 23]. Furthermore, recurrence of HCV viremia has been shown to follow the loss of HCV-specific T Helper cell responses[11]. In chimpanzees serially infected by HCV, recovered animals did not have detectable antibody against the HCV envelope glycoproteins, while rapid control of secondary infection was associated with a strong T-cell proliferative response and expansion of memory CD4+ and CD8+ T cells[27-29].

Development of an effective HCV vaccine faces strong obstacles, principal among them being the high level of HCV protein sequence diversity[30]. For vaccines to be effective, responses covering a wide range of variants are required, as single amino acid substitutions can completely abrogate recognition by HLA class I restricted CD8+ cytotoxic and class II restricted CD4+ T-helper cells[24].

For HIV-1, a similarly variable virus, there has been strong interest in rational vaccine design, a relatively new discipline that attempts to define optimal vaccine sequences that minimize differences from the circulating strains while maximizing immunogenicity[33]. Even though these vaccine constructs are in a sense artificial, HIV-1 experiments showed that artificially created consensus and ancestral envelope proteins retained folding and conformational antibody binding characteristics, and responses to the vaccine showed enhanced B- and T-cell cross-reactivity compared to natural strains[34, 35].

Recently, a new computational approach to the design of polyvalent vaccine antigens for T-cell based vaccines was developed and applied to HIV-1[32]. These antigens consist of sets of "mosaic" proteins which are computationally generated recombinants assembled from fragments of natural sequences and selected to be optimal using a genetic algorithm. Mosaic proteins resemble natural proteins, but are optimized to maximize the coverage of potential T-cell epitopes (nonamer peptides) found in natural sequences and to reduce the number of rare or unique 9-mers to avoid vaccine-specific responses. A small set of 3-4 such HIV-1 "mosaic proteins" provided comparable coverage to thousands of separate peptides. Mosaic proteins can be synthesized and expressed and are immunogenic in mice[36]. When mosaic constructs for HIV-1 were compared to natural strains in DNA vaccines in mice[37], the two- or three-mosaic Env sets elicited the optimal CD4 and CD8 responses. These responses were most evident in CD8 T cells; the three-mosaic set elicited responses to an average of eight peptide pools, compared to two pools for a set of three natural Envs, indicating that synthetic mosaic antigens can induce T-cell responses with expanded breadth and may facilitate the development of effective T-cell-based vaccines.

SUMMARY OF THE INVENTION

The invention provides immunogenic compositions useful as HCV vaccines. Provided are HCV mosaic polypeptide and nucleic acid compositions which provide higher levels of T-cell epitope coverage while minimizing the occurrence of unnatural and rare epitopes compared to natural HCV polypeptides and consensus HCV sequences.

In one embodiment, the invention provides a monovalent HCV mosaic vaccine composition, comprising a polypeptide selected from the group consisting (a) the polypeptide of SEQ ID NO: 1 and (b) the polypeptide of SEQ ID NO: 32. In another embodiment, the invention provides a multivalent HCV mosaic vaccine comprising a set of polypeptides selected from the group consisting of (a) the polypeptides of SEQ ID NOS: 2 and 3, (b) the polypeptides of SEQ ID NOS: 4-6, and (c) the polypeptides of SEQ ID NOS: 7-11. A multivalent HCV mosaic vaccine of the invention may also comprising a set of polypeptides selected from the group consisting of (a) the polypeptides of SEQ ID NOS: 33-34, (b) the polypeptides of SEQ ID NOS: 35-37, and (c) the polypeptides of SEQ ID NOS: 38-41. Yet another multivalent HCV mosaic vaccine comprises a set of polypeptides selected from the group consisting of (a) the polypeptides of SEQ ID NOS: 42-44, and (b) the polypeptides of SEQ ID NOS: 45-48.

In another embodiment, a globally-oriented multivalent HCV mosaic vaccine is provided, and comprises the five polypeptides of SEQ ID NOS: 49-53, or the five polypeptides of SEQ ID NOS: 54-58.

In addition to compositions in which mosaic proteins encode all or part of an HCV polyprotein, the invention provides mosaic vaccine compositions in which all or part of the HCV polyprotein is fragmented to present individual HCV proteins.

Nucleic acid molecules encoding HCV mosaic proteins are also provided, and may be used for the generation of the mosaic proteins of the invention, and as nucleic acid based HCV vaccines. In one embodiment, the invention provides a nucleic acid molecule comprising a polynucleotide encoding a polypeptide which has an amino acid sequence selected from the group consisting of SEQ ID NOS: 1-58. In another embodiment, the invention provides a nucleic acid molecule comprising a polynucleotide encoding a distinct HCV protein within an HCV polyprotein mosaic protein which has an amino acid sequence selected from the group consisting of SEQ ID NOS: 1-58.

SEQUENCE LISTING

Figure 1A:
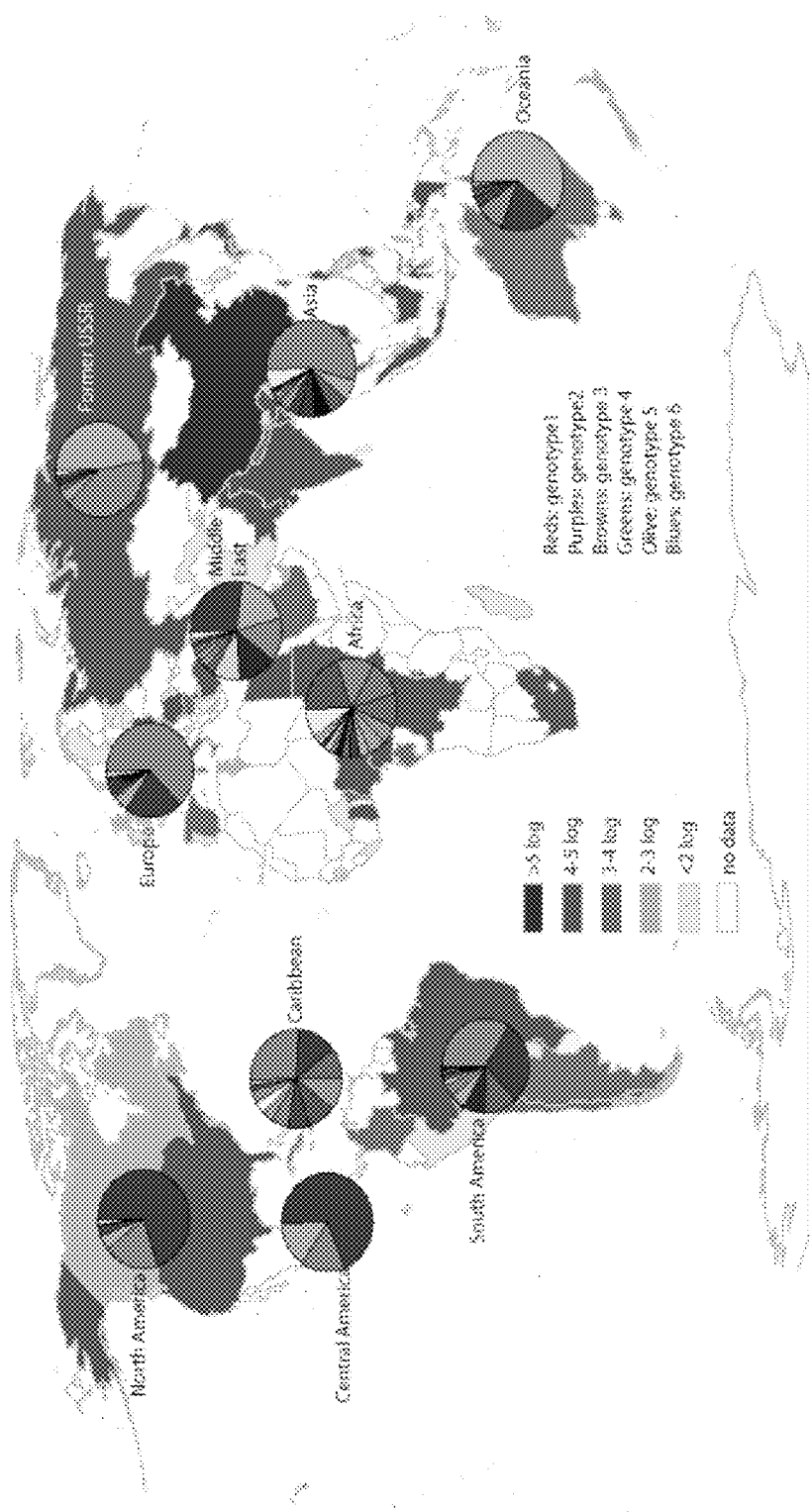
FIG. 1. HCV phylogeny, prevalence in the world and comparison to HIV-1. (A) HCV genotypes around the world. Shades in the map show the number of infected people in different nations based on the population prevalence of HCV, and the distribution of genotypes in the HCV sequences from 10 geographic regions contained in the Los Alamos HCV database. Sources: HCV prevalence data: Weekly epidemiological record, No. 6, 2002, 77, 41-48. (B) Phylogenetic tree comparison of HCV and HIV, genotypes, groups and subtypes. Trees are based on manually curated representative complete genome sequence alignments for both viruses. The Findmodel tool was used to determine the best substitution model, which was GTR plus Gamma for both datasets. The trees were constructed using this model in PAUP.

The amino acid sequences listed in the accompanying sequence listing are shown using standard three letter code, as defined in 37 C.F.R. 1.822. The Sequence Listing is submitted as an ASCII text file, created on Jan. 14, 2011, 1.44 MB, which is incorporated by reference herein.

DETAILED DESCRIPTION OF THE INVENTION

Definitions

Unless otherwise defined, all terms of art, notations and other scientific terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. The techniques and procedures described or referenced herein are generally well understood and commonly employed using conventional methodology by those skilled in the art, such as, for example, the widely utilized molecular cloning methodologies described in Sambrook et al., Molecular Cloning: A Laboratory Manual 3rd. edition (2001) Cold Spring Harbor Laboratory Press, Cold Spring Harbor, N.Y.; Current Protocols in Molecular Biology (Ausbel et al., eds., John Wiley & Sons, Inc. 2001. As appropriate, procedures involving the use of commercially available kits and reagents are generally carried out in accordance with manufacturer defined protocols and/or parameters unless otherwise noted.

The term "hepatitis C virus" (HCV) refers to an agent causative of Non-A, Non-B Hepatitis (NANBH). The nucleic acid and amino acid sequences of various HCVs are known. The disease caused by HCV is called hepatitis C, formerly called NANBH. The term HCV, as used herein, denotes a viral species of which pathogenic strains cause NANBH, as well as attenuated strains or defective interfering particles derived therefrom. HCV is a member of the viral family flaviviridae. The morphology and composition of Flavivirus particles are known, and are discussed in Reed et al., Curr. Stud. Hematol. Blood Transfus. (1998), 62:1-37; HEPATITIS C VIRUSES IN FIELDS VIROLOGY (B. N. Fields, D. M. Knipe, P. M. Howley, eds.; 3d ed., 1996). It has recently been found that portions of the HCV genome are also homologous to pestiviruses. Morphologically, Flaviviruses contain a central nucleocapsid surrounded by a lipid bilayer. HCV virions are spherical and have a diameter of about 40-50 nm, with the core element being 25-30 nm in diameter. Along the outer surface of the virion envelope are projections that are about 5-10 nm long with terminal knobs about 2 nm in diameter. The HCV genome is comprised of RNA. It is known that RNA containing viruses have relatively high rates of spontaneous mutation. Therefore, there are multiple HCV strains and isolates of divergent sequences, which can be virulent or a virulent, within the HCV class or species.

An "HCV protein" or "HCV polypeptide" is a polypeptide derived from an HCV. The polypeptide need not be physically derived from HCV, but may be synthetically or recombinantly produced. Moreover, the polypeptide may be derived from any of the various HCV strains, such as from HCV strains 1, 2, 3, 4, 5 or 6. A number of conserved and variable regions are known between these strains and, in general, the amino acid sequences of epitopes derived from these regions will have a high degree of sequence homology.

A polypeptide or protein "fragment" refers to a polypeptide consisting of only a part of the intact full-length polypeptide sequence and structure. The fragment may include a C-terminal deletion and/or an N-terminal deletion of the native or other progenitor polypeptide.

A "polyvalent" HCV mosaic protein or vaccine composition refers to a set of mosaic proteins or polypeptides, whereas a "monovalent" HCV mosaic protein or vaccine refers to a single mosaic protein or polypeptide. A "mosaic vaccine" comprises one or more mosaic proteins or polypeptides. The terms "mosaic polypeptide", and "mosaic protein" refer to polypeptides and combinations of such polypeptides, wherein the polypeptides are assembled/generated from fragments of natural sequences using a genetic algorithm. In the practice of the method of the invention, mosaic vaccine sequences may be computationally derived using the methods of Fischer et al., 2007, Nature Medicine 13(1): 100-106. Mosaic HCV proteins resemble natural HCV proteins, but are optimized in order to maximize coverage of potential T-cell epitopes found in natural sequences and reduce the presence of rare 9-mers which enables broader immune response.

An "immunological response" to an HCV mosaic protein or vaccine composition (including both polypeptide and polynucleotides encoding polypeptides that are expressed in vivo) or composition is the development in a subject of a humoral and/or a cellular immune response to molecules present in the composition of interest. For purposes of the present invention, a "humoral immune response" refers to an immune response mediated by antibody molecules, while a "cellular immune response" is one mediated by T-lymphocytes and/or other white blood cells. One important aspect of cellular immunity involves an antigen-specific response by cytolytic T-cells ("CTLs"). CTLs have specificity for peptide antigens that are presented in association with proteins encoded by the major histocompatibility complex (SMC) and expressed on the surfaces of cells. CTLs help induce and promote the intracellular destruction of intracellular microbes, or the lysis of cells infected with such microbes. Another aspect of cellular immunity involves an antigen-specific response by helper T-cells. Helper T-cells act to help stimulate the function, and focus the activity of, nonspecific effector cells against cells displaying peptide antigens in association with MHC molecules on their surface. A "cellular immune response" also refers to the production of cytokines, chemokines and other such molecules produced by activated T-cells and/or other white blood cells, including those derived from CD4+ and CD8+ T-cells. A vaccine composition that elicits a cellular immune response may serve to sensitize a vertebrate subject by the presentation of antigen in association with MHC molecules at the cell surface. The cell-mediated immune response is directed at, or near, cells presenting antigen at their surface. In addition, antigen-specific T-lymphocytes can be generated to allow for the future protection of an immunized host.

The term "nucleic acid immunization" refers to the introduction of a nucleic acid molecule encoding one or more selected antigens into a host cell, for the in vivo expression of the antigen or antigens. The nucleic acid molecule can be introduced directly into the recipient subject, such as by injection, inhalation, oral, intranasal and mucosal administration, or the like, or can be introduced ex vivo, into cells which have been removed from the host. In the latter case, the transformed cells are reintroduced into the subject so that an immune response can be mounted against the antigen encoded by the nucleic acid molecule.

The term "nucleic acid" refers to deoxyribonucleotides or ribonucleotides and polymers thereof ("polynucleotides") in either single- or double-stranded form. Unless specifically limited, the term "polynucleotide" encompasses nucleic acids containing known analogues of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g. degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer et al., 1991, Nucleic Acid Res. 19: 5081; Ohtsuka et al., 1985 J. Biol. Chem. 260: 2605-2608;

and Cassol et al., 1992; Rossolini et al., 1994, Mol. Cell. Probes 8: 91-98). The term nucleic acid is used interchangeably with gene, cDNA, and mRNA encoded by a gene.

The terms "polypeptide," "peptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymers.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

The term "conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention.

The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, *Proteins* (1984)).

Macromolecular structures such as polypeptide structures can be described in terms of various levels of organization. For a general discussion of this organization, see, e.g., Alberts et al., *Molecular Biology of the Cell* ($3^{rd}$ ed., 1994) and Cantor and Schimmel, *Biophysical Chemistry Part I: The Conformation of Biological Macromolecules* (1980). "Primary structure" refers to the amino acid sequence of a particular peptide. "Secondary structure" refers to locally ordered, three dimensional structures within a polypeptide. These structures are commonly known as domains. Domains are portions of a polypeptide that form a compact unit of the polypeptide and are typically 25 to approximately 500 amino acids long. Typical domains are made up of sections of lesser organization such as stretches of β-sheet and α-helices. "Tertiary structure" refers to the complete three dimensional structure of a polypeptide monomer. "Quaternary structure" refers to the three dimensional structure formed by the noncovalent association of independent tertiary units. Anisotropic terms are also known as energy terms.

The term "isolated" refers to material which is substantially or essentially free from components which normally accompany the material as it is found in the cellular environment in which it is produced. However, the term "isolated" is not intended refer to the components present in an electrophoretic gel or other separation medium. An isolated component is free from such separation media and in a form ready for use in another application or already in use in the new application/milieu. An "isolated" protein is one that has been identified and separated and/or recovered from a component of its natural environment. Contaminant components of its natural environment are materials that would interfere with therapeutic uses for the protein, and may include enzymes, hormones, and other proteinaceous or non-proteinaceous solutes. In preferred embodiments, an isolated protein is one which is purified (1) to greater than 75% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain.

The term "heterologous" when used with reference to portions of a nucleic acid indicates that the nucleic acid comprises two or more subsequences that are not found in the same relationship to each other in nature. For instance, a nucleic acid is typically recombinantly produced, having two or more sequences from unrelated genes arranged to make a new functional nucleic acid, e.g., a nucleic acid encoding a protein from one source and a nucleic acid encoding a peptide sequence from another source. Similarly, a heterologous protein indicates that the protein comprises two or more subsequences that are not found in the same relationship to each other in nature (e.g., a fusion protein).

The terms "identical" or percent "identity," in the context of two or more nucleic acids or polypeptide sequences, refer to two or more sequences or subsequences that are the same or have a specified percentage of amino acid residues or nucleotides that are the same (i.e., about 70% identity, preferably 75%, 80%, 85%, 90%, or 95% identity over a specified region, when compared and aligned for maximum correspondence over a comparison window, or designated region as measured using a sequence comparison algorithms, or by manual alignment and visual inspection. This definition also refers to the complement of a test sequence, which has substantial sequence or subsequence complementarity when the test sequence has substantial identity to a reference sequence. This definition also refers to the complement of a test sequence, which has substantial sequence or subsequence complementarity when the test sequence has substantial identity to a reference sequence.

When percentage of sequence identity is used in reference to polypeptides, it is recognized that residue positions that are not identical often differ by conservative amino acid substitutions, where amino acids residues are substituted for other amino acid residues with similar chemical properties (e.g., charge or hydrophobicity) and therefore do not change the functional properties of the polypeptide. Where sequences differ in conservative substitutions, the percent sequence identity may be adjusted upwards to correct for the conservative nature of the substitution.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, 1981, Adv. Appl. Math. 2:482, by the homology alignment algorithm of Needleman & Wunsch, 1970, J. Mol. Biol. 48:443, by the search for similarity method of Pearson & Lipman, 1988, Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Current Protocols in Molecular Biology (Ausubel et al., eds. 1995 supplement)).

A preferred example of algorithm that is suitable for determining percent sequence identity and sequence similarity are the BLAST and BLAST 2.0 algorithms, which are described in Altschul et al., 1977, Nuc. Acids Res. 25:3389-3402 and Altschul et al., 1990, J. Mol. Biol. 215:403-410, respectively. BLAST and BLAST 2.0 are used, typically with the default parameters described herein, to determine percent sequence identity for the nucleic acids and proteins of the invention. Software for performing BLAST analyses is publicly available through the National Center for Biotechnology Information. This algorithm involves first identifying high scoring sequence pairs (HSPS) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPS containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word length (W) of 11, an expectation (E) of 10, $M=5$, $N=-4$ and a comparison of both strands. For amino acid sequences, the BLASTP program uses as defaults a word length of 3, and expectation (E) of 10, and the BLOSUM62 scoring matrix (see Henikoff & Henikoff, Proc. Natl. Acad. Sci. USA 89:10915 (1989)) alignments (B) of 50, expectation (E) of 10, $M=5$, $N=-4$, and a comparison of both strands.

The BLAST algorithm also performs a statistical analysis of the similarity between two sequences (see, e.g., Karlin & Altschul, 1993, Proc. Nat'l. Acad. Sci. USA 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

The phrase "stringent hybridization conditions" refers to conditions under which a probe will hybridize to its target subsequence, typically in a complex mixture of nucleic acid, but to no other sequences. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology—Hybridization with Nucleic Probes, "Overview of principles of hybridization and the strategy of nucleic acid assays" (1993). Generally, highly stringent conditions are selected to be about 5-10° C. lower than the thermal melting point (Tm) for the specific sequence at a defined ionic strength pH. Low stringency conditions are generally selected to be about 15-30° C. below the Tm. Tm is the temperature (under defined ionic strength, pH, and nucleic concentration) at which 50% of the probes complementary to the target hybridize to the target sequence at equilibrium (as the target sequences are present in excess, at Tm, 50% of the probes are occupied at equilibrium). Stringent conditions will be those in which the salt concentration is less than about 1.0M sodium ion, typically about 0.01 to 1.0M sodium ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. For selective or specific hybridization, a positive signal is at least two times background, preferably 10 times background hybridization.

Nucleic acids that do not hybridize to each other under stringent conditions are still substantially identical if the polypeptides which they encode are substantially identical. This occurs, for example, when a copy of a nucleic acid is created using the maximum codon degeneracy permitted by the genetic code. In such cased, the nucleic acids typically hybridize under moderately stringent hybridization conditions.

HCV Mosaic Protein Vaccines

In one aspect, the invention provides HCV mosaic vaccine compositions comprising one or more mosaic proteins. Such HCV mosaic protein vaccines may comprise cocktails of k composite proteins (k being the number of sequence variants in the cocktail), optimized to include the maximum number of potential T-cell epitopes in an input set of viral proteins. The mosaic proteins are generated from natural sequences using genetic algorithms.

Mosaic proteins resemble natural proteins and include the most common forms of potential epitopes. Since CD8+ epitopes are contiguous and typically nine amino-acids long, sets of mosaics can be scored by "coverage" of nonamers (9-mers) in the natural sequences (fragments of similar lengths are also well represented). The HCV mosaic protein design strategy of the invention provides the level of diversity coverage achieved by a massively polyvalent multiple-peptide vaccine, but with important advantages. Vaccine delivery may use intact mosaic proteins or genes. Mosaic proteins exclude low-frequency or unnatural epitopes that are not relevant to circulating strains. Additionally, mosaic proteins resemble native proteins, and may therefore undergo natural processing within the infected cell, in contrast to HCV vaccine designs in which sets of concatenated epitopes are linked (48).

The HCV mosaic vaccines of the invention aim for broader, more globally targeted immunological coverage. In view of applicants determination that immunological coverage diminishes rapidly with increased protein variability in the vaccine composition, preferred HCV mosaic vaccines comprise cocktails of individual mosaics designed the more conservative HCV proteins. For example, as disclosed herein, a three-antigen HCV mosaic vaccine based upon HCV genotype 1 displayed 83% immunological coverage, compared to only 50% coverage displayed by the prototype H77 natural HCV sequence (see Example 1).

The HCV mosaic vaccines of the invention approach near-maximal potential epitope coverage and minimize the number of rare epitopes likely to elicit strain-specific immune responses. For example, the mosaic vaccine approach of the invention proved optimal in terms of providing improved epitope coverage, from just 50% for a an HCV vaccine based upon the natural H77 HCV strain, to 83% with the tetravalent HCV mosaic vaccine described in Example 3. Moreover, the vaccine composition described in Example 3 does not include unnatural or unique epitopes.

An important consideration for any HCV vaccine is its scope. HCV genotype prevalence has geographic associations (Simmonds, 2004, J Gen Virol 85(11): 3173-3188) (FIG. 1A). While genotype 1 is prevalent in Europe and the United States, genotypes 2, 1, 4, 3 and 6 are common in Africa and Asia. Patients with genotype 1 infection have poorer responses to treatment (42, 43). Thus the strong interest in a genotype 1 vaccine (30). A single-genotype vaccine would certainly be useful, and would present fewer design difficulties. Ultimately, however, a vaccine that can provide global protection would obviously be better.

Figure 1B:
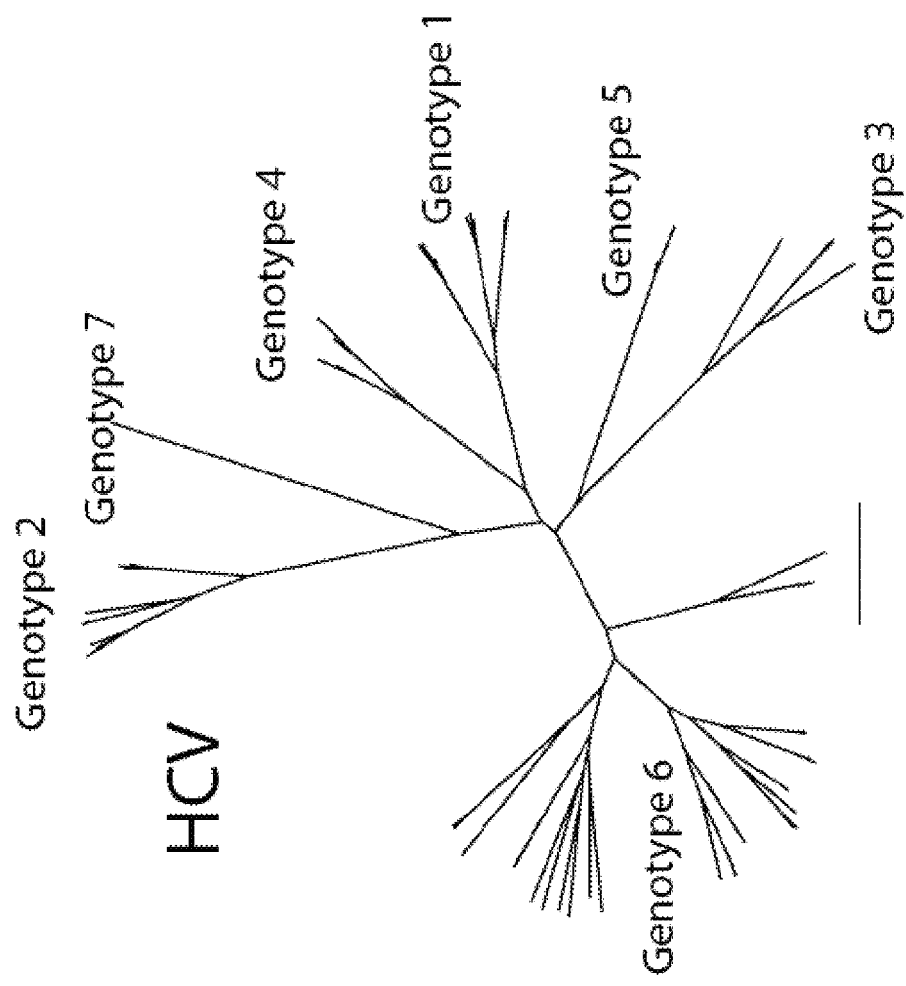
Figure 1B:
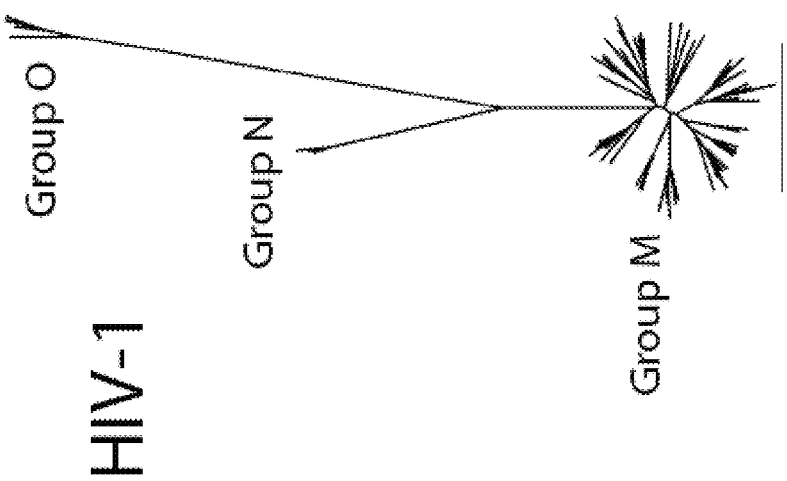

The HIV field faces a similar dilemma, and both single-clade and multi-clade vaccines are being studied, as well as consensus and ancestral sequences, inclusion of only conserved regions, and mosaics (31-33, 44). FIG. 1B compares the genetic variability of HCV and HIV through phylogenetic trees drawn on the same scale. While the overall genetic distances are comparable, HIV-1 vaccine efforts only address the HIV-1 M group, the "main" group in the global pandemic, and not the rare O and N groups. Clearly, a global HIV vaccine needs to cover much less diversity than HCV, underscoring the difficulties for the design of a global vaccine for HCV.

In preferred embodiments of a globally-oriented HCV vaccine, highly variable HCV proteins are not included in the design, in view of observations like the diminished protein coverage generated with NS2 protein (only 38%). Thus, vaccine compositions based upon the more conserved Core, NS3, NS4 and certain parts of NS5 are preferred. In one embodiment, and HCV vaccine of the invention provided more than 75% coverage for all HCV proteins. In other embodiments, more variable protein sequences are included in the vaccine composition when genotype-specific immunization is desired.

The HCV mosaic vaccine design strategies described herein are also useful in generating HCV mosaic vaccine preparations that may provide coverage for all 6 HCV genotypes worldwide. As shown in Examples 20 and 21, pan-genotype, global-coverage HCV mosaic vaccine cocktails provided better coverage than natural or consensus strain vaccines containing the same number of variants, while also possessing the added feature of covering significantly fewer rare epitopes.

In the several Examples which follow, various HCV mosaic protein vaccines, including various multivalent mosaic vaccine cocktails, were generated and evaluated for epitope coverage and the minimization of rare and strain-specific epitopes. Out of 8 single sequence strategies (monovalent mosaic protein), the reference strain H77 (common laboratory HCV strain) provided the worst 9-mer coverage (about 50%) of genotype 1 sequences, and the single mosaic sequence (Example 1) provided the best coverage (about 60%). In addition, the mosaic sequence does not have any unique or unnatural nonamers. The coverage can be significantly improved if more sequences are used. A cocktail of 3 mosaic sequences (Example 3) provides 83% coverage; and, 4 mosaics are slightly better than 3 (Example 4).

Figure 2A:
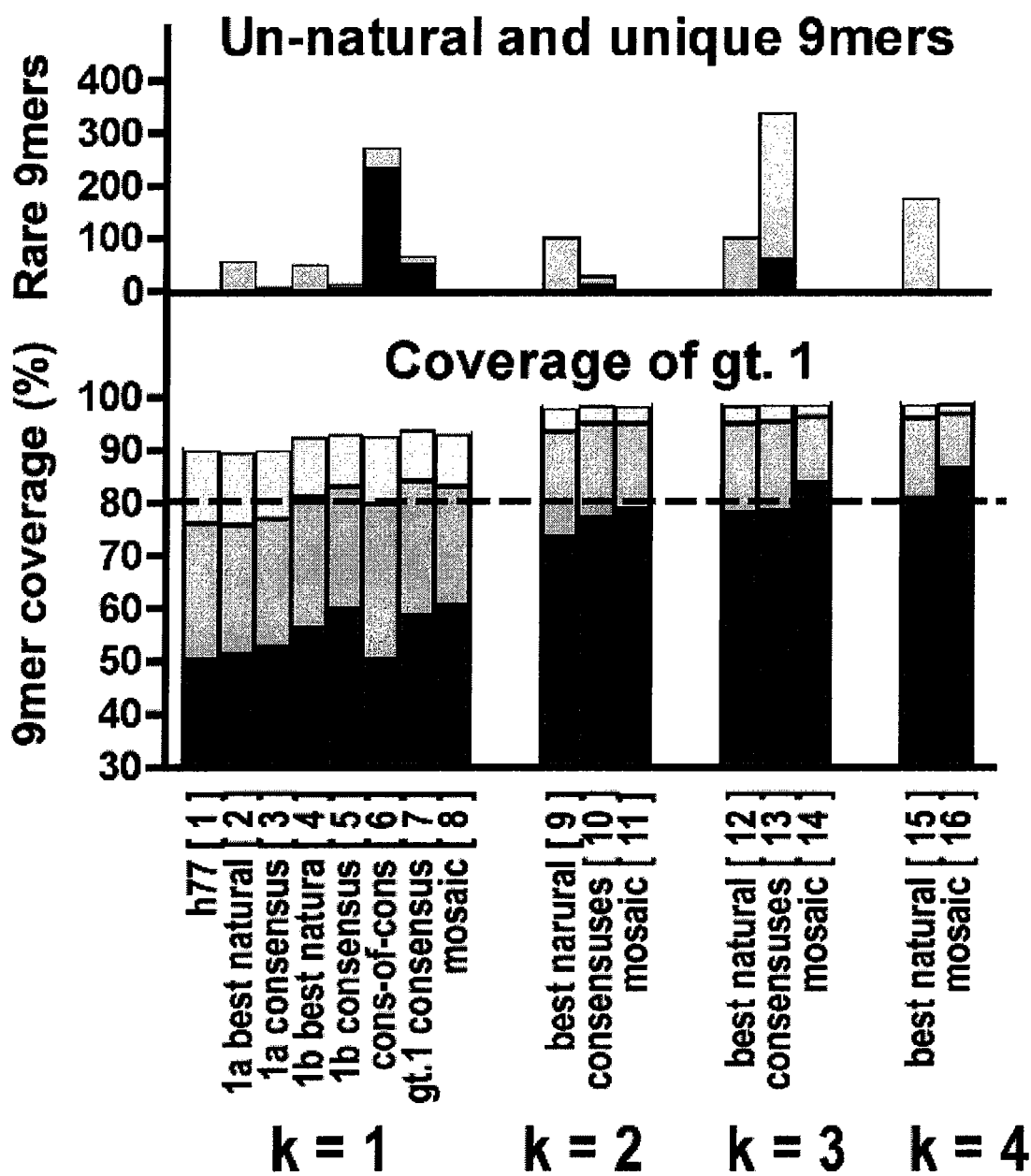
FIG. 2. Comparison of HCV vaccine candidates for a genotype 1 optimized vaccine, expressed as coverage of 9-mers in genotype 1 sequences. Exact, 8 of 9 (one-off), and 7 of 9 (two-off) 9-mer coverage of complete genome sequences was calculated and plotted. "k" is the number of sequences in the cocktail. (A) The lower portion of the graph shows 9-mer coverage of 375 genotype 1 sequences by 1- through 4-valent vaccine cocktail strategies. The upper portion of the graph shows number of un-natural (black) and unique (grey) 9-mers present in each vaccine candidate. (B) Within- and between-subtype coverage. The 9-mer coverage was calculated against 143 1a and 229 1b sequences. Mosaics were optimized using the following training sets: (i) only genotype 1a sequences; (ii) only genotype 1b sequences; (iii) genotypes 1a and 1b sequences combined; (iv) genotype 1 sequences (1a, 1b, 1c combined). C) Coverage of genotypes 1a, 1b and 1c by simultaneously and serially optimized mosaics. Each cocktail was tested against genotype 143 1a sequences (1a), 229 genotype 1b sequences (1b) and 3 genotype 1c sequences (1c).
Figure 2B:
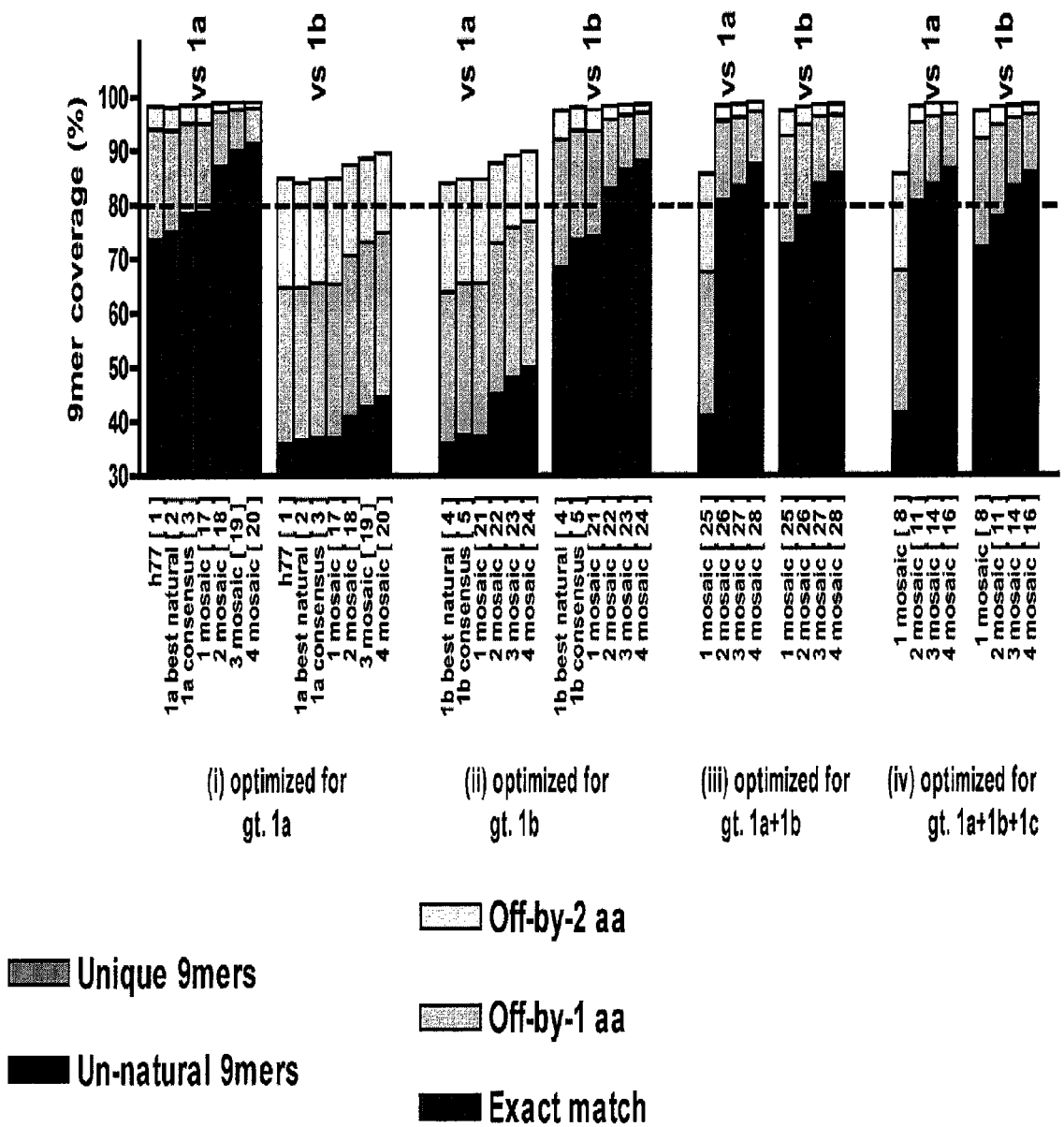

Many immunological experiments on genotype 1 use genotype 1a sequences. However, when chimpanzees that had recovered from genotype 1a and 1b infections were challenged with the homologous and heterologous genotype, 36% of heterologous challenges resulted in chronic infections[45]. Similar results were reported in humans[46,47]. In view of the importance of estimating how well mosaic vaccine cocktails would perform outside of the population they were designed for, various HCV mosaic vaccine cocktails optimized for several reference sequence sets were generated and evaluated for epitope coverage and the minimization of rare epitope coverage, as described in the examples sections which follow. These HCV mosaic vaccine cocktails included those optimized against (i) only genotype 1a; (ii) only genotype 1b; (iii) genotypes 1a+1b; and (iv) genotypes 1a+1b+1c (FIG. 2B).

Natural, consensus and mosaic cocktail vaccines designed for one subtype generally provided very poor coverage for other subtypes, illustrating why cross-subtype common reinfection is common even within the same genotype[45-47]. In contrast, cocktails designed for all of genotype 1 (Examples 1-4) showed dramatically better overall coverage, without reducing within-subtype coverage. For example, the 3-mosaic cocktail designed for all genotype 1 sequences (Example 3) provided >80% coverage of 9-mers from both subtypes 1a and 1b (see FIG. 2B).

Figure 2C:
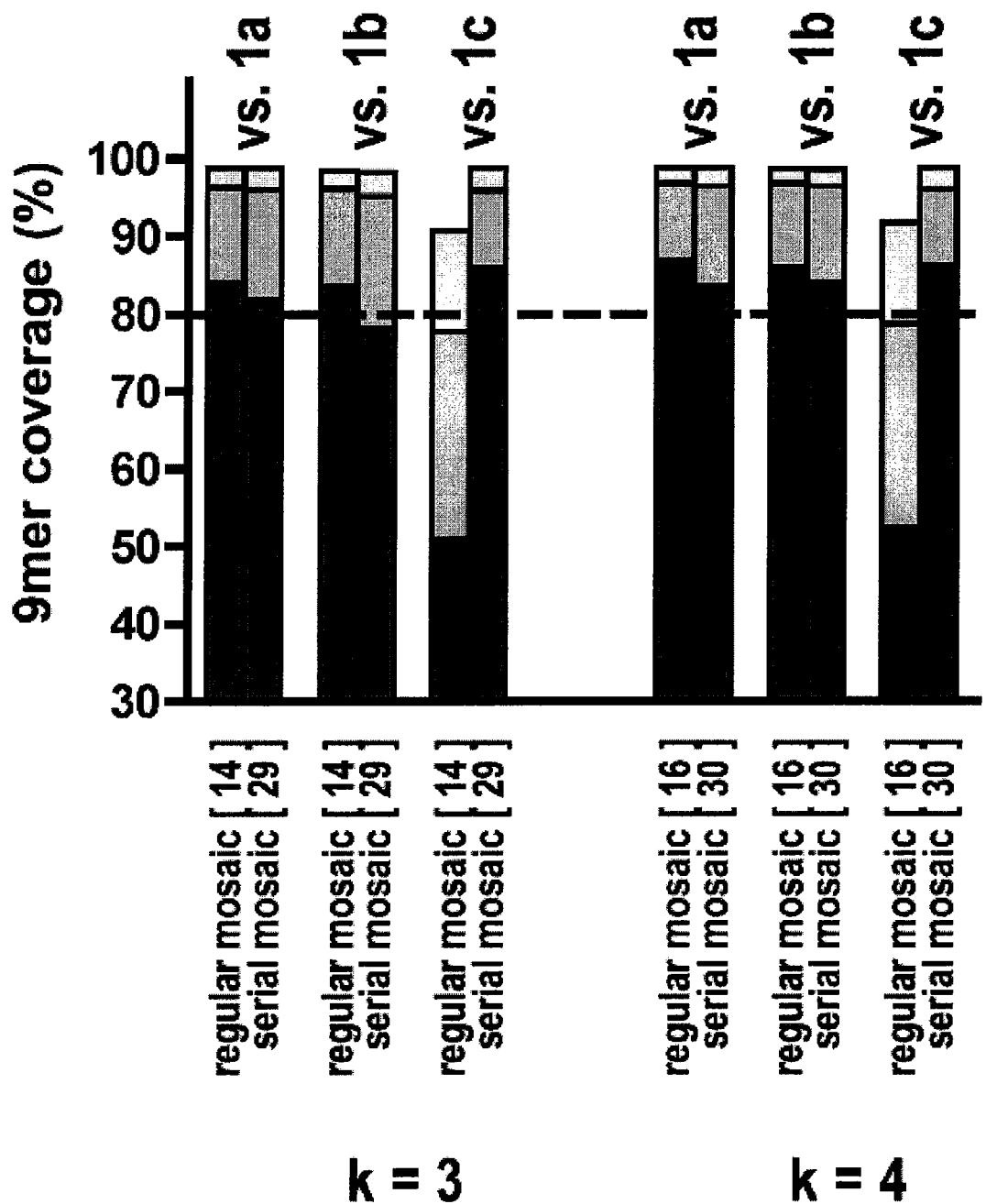

In an effort to minimize sampling frequency bias, the invention further provides a serial optimization strategy, which may be employed as described in Examples 17, 18 and 21. The invention's serial optimization strategy is aimed at counteracting the effects of different sampling frequencies. As described further in Examples 17, 18 and 21, this approach succeeds at improving coverage of genotype 1c in the presence of 1a and 1b, as well as improving the coverage of a global HCV vaccine design. While subtype 1c is not common, some of the genotypes with few available sequences are epidemiologically important, and in general, the serial optimization strategy can be used to improve the coverage of under-sampled clades, without significantly diminishing coverage of more common clades. Comparison of tri- or tetravalent cocktails obtained via regular or serial optimization shows that the coverage of subtypes 1a and 1b is stable with serial optimization, while coverage of the rare subtype 1c improves greatly (FIG. 2C).

Figure 4:
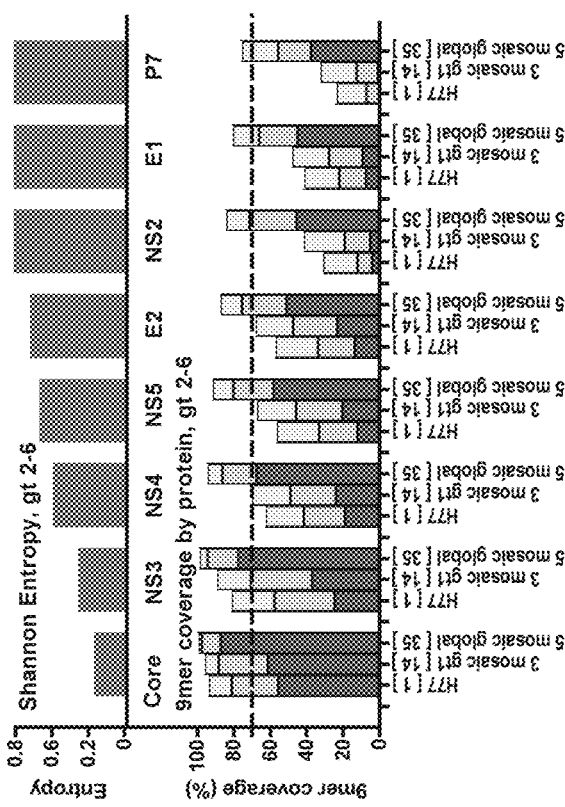
FIG. 4. Variability and coverage of HCV protein regions. Upper portions of both graphs: mean Shannon entropy at each position. Lower portion of each graph: 9-mer coverage provided by three vaccine candidates. (A) Calculated against 375 genotype 1 sequences. (B) Calculated against 92 sequences of genotypes 2 through 6 combined.
Figure 4:
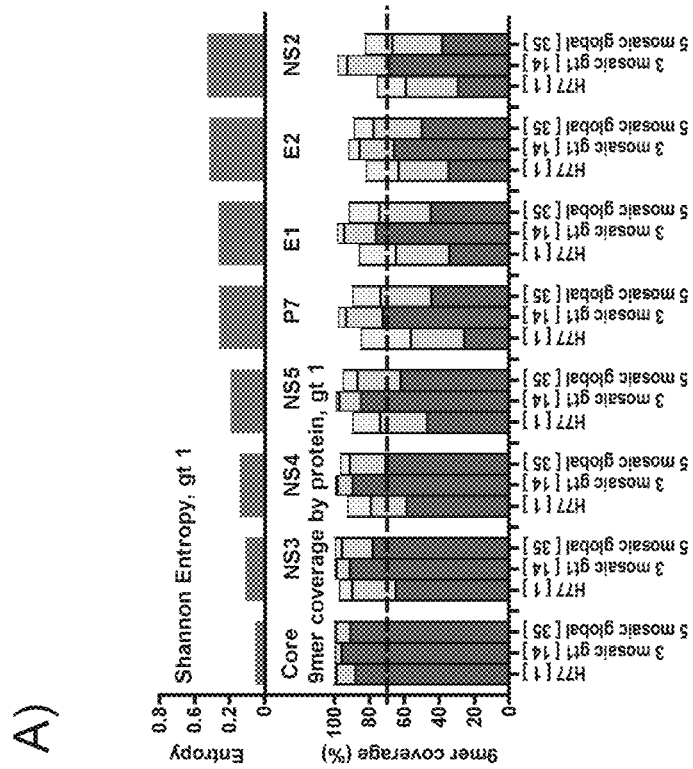

HCV mosaic proteins and vaccine compositions with relatively low variability have higher intrinsic coverage levels. FIG. 4 illustrates the relation between the Shannon entropy of HCV proteins and their coverage by the H77 reference strain (strategy 1), the 3-mosaic genotype 1 cocktail (strategy 14) and the 5-mosaic global cocktail (strategy 35), for genotype 1 (FIG. 4A) and genotypes 2-6 (FIG. 4B). The HCV Core protein has low variability, and the global cocktail (Example 21) provides 91% coverage. As protein variability increases, the coverage provided by the global vaccine drops to 38% of genotype 1 coverage for the variable NS2 protein (FIG. 4A) and comparable coverage of other genotypes for P7 (FIG. 4B). In contrast, the coverage of genotype 1 provided by a genotype 1 oriented vaccine (Example 3) remains high (more than 75%) for all proteins. This suggests that genotype-specific vaccines might still be effective when based on the more variable proteins.

To explore the potential for mosaic designs to improve the coverage of longer epitopes, the assessment criteria used in the Examples may be changed top calculate coverage of 12-mers in all proteins. This was done with respect to the mosaic vaccine compositions described in Examples 3 and 21, and showed that coverage of 12-mer mosaics was in all cases very similar to that of 9-mers, suggesting that both CTL and T-helper responses may be optimized using the mosaic design strategy.

Preparation of HCV Mosaic Proteins

HCV mosaic proteins may be prepared using various methods well known in the art, including by peptide synthesis and recombinant production means. For example, a mosaic polypeptide may be synthesized according to standard solid-phase methodologies, utilizing the amino acid sequences provided herein, such as may be performed on an Applied Biosystems Model 430A peptide synthesizer (Applied Biosystems, Foster City, Calif.), according to manufacturer's instructions. Other methods of synthesizing peptides or peptidomimetics, either by solid phase methodologies or in liquid phase, are well known to those skilled in the art.

The Mosaic proteins of the invention can be expressed in a variety of host cells, including *E. coli*, other bacterial hosts, yeast, and various higher eukaryotic cells such as the COS, CHO and HeLa cells lines and myeloma cell lines. The host cells can be mammalian cells, insect cells, or microorganisms, such as, for example, yeast cells, bacterial cells, or fungal cells. HCV mosaic proteins may be expressed intracellularly, or can be secreted from the cell. Intracellular expression often results in high yields. If necessary, the amount of soluble, active fusion polypeptide may be increased by performing refolding procedures (see, e.g., Sambrook et al., supra.; Marston et al., *Bio/Technology* (1984) 2: 800; Schoner et al., *Bio/Technology* (1985) 3: 151).

In this regard, there are many expression systems for producing the mosaic proteins of the invention that are well know to those of ordinary skill in the art. (See, e.g., *Gene Expression Systems*, Fernandes and Hoeffler, Eds. Academic Press, 1999; Russell & Sambrook, supra). Commonly used prokaryotic control sequences, which are defined herein to include promoters for transcription initiation, optionally with an operator, along with ribosome binding site sequences, include such commonly used promoters as the beta-lactamase (penicillinase) and lactose (lac) promoter systems, the tryptophan (trp) promoter, the tac promoter and the lambda-derived $P_L$ promoter and N-gene ribosome binding site. The particular promoter system is not critical to the invention, any available promoter that functions in prokaryotes can be used. Standard bacterial expression vectors include plasmids such as pET, pTET, pBR322-based plasmids, e.g., pBLUESCRIPT™, pSKF, pET23D, λ-phage derived vectors, p15A-based vectors and fusion expression systems such as GST. Epitope tags can also be added to recombinant proteins to provide convenient methods of isolation, e.g., c-myc, HA-tag, 6-His tag, maltose binding protein, VSV-G tag, anti-DYKDDDDK tag, or any such tag, a large number of which are well known to those of skill in the art.

For expression of polypeptides in prokaryotic cells other than *E. coli*, regulatory sequences for transcription and translation that function in the particular prokaryotic species is required. Such promoters can be obtained from genes that have been cloned from the species, or heterologous promoters can be used. For example, the hybrid trp-lac promoter functions in *Bacillus* in addition to *E. coli*. These and other suitable bacterial promoters are well known in the art and are described, e.g., in Russell & Sambrook and Ausubel et al. Bacterial expression systems for expressing the proteins of the invention are well known and commercially available.

Similarly, the for expression of polypeptides in eukaryotic cells, transcription and translation sequences that function in the particular eukaryotic species are required. For example, eukaryotic expression systems for mammalian cells, yeast, and insect cells are well known in the art and are also commercially available. In yeast, vectors include Yeast Integrating plasmids (e.g., YIp5) and Yeast Replicating plasmids (the YRp series plasmids) and pGPD-2. Expression vectors containing regulatory elements from eukaryotic viruses are typically used in eukaryotic expression vectors, e.g., SV40 vectors, papilloma virus vectors, and vectors derived from Epstein-Barr virus. Other exemplary eukaryotic vectors include those employing the CMV promoter, metallothionein promoter, murine mammary tumor virus promoter, Rous sarcoma virus promoter, polyhedrin promoter, or other promoters shown effective for expression in eukaryotic cells.

Either constitutive or regulated promoters can be used in the present invention. Regulated promoters can be advantageous because the host cells can be grown to high densities before expression of the polypeptide is induced. High level expression of heterologous proteins slows cell growth in some situations. An inducible promoter is a promoter that directs expression of a gene where the level of expression is alterable by environmental or developmental factors such as, for example, temperature, pH, anaerobic or aerobic conditions, light, transcription factors and chemicals.

Inducible promoters for other organisms are also well known to those of skill in the art. These include, for example, the metallothionein promoter, the heat shock promoter, as well as many others.

Translational coupling may be used to enhance expression as is well known. The strategy uses a short upstream open reading frame derived from a highly expressed gene native to the translational system, which is placed downstream of the promoter, and a ribosome binding site followed after a few amino acid codons by a termination codon. Just prior to the termination codon is a second ribosome binding site, and following the termination codon is a start codon for the initiation of translation. The system dissolves secondary structure in the RNA, allowing for the efficient initiation of translation.

Once expressed, the recombinant polypeptides can be purified according to standard procedures of the art, including ammonium sulfate precipitation, affinity columns, column chromatography, gel electrophoresis and the like (see, generally, R. Scopes, *Protein Purification*, Springer-Verlag, N.Y. (1982), Deutscher, *Methods in Enzymology Vol. 182: Guide to Protein Purification.*, Academic Press, Inc. N.Y. (1990)).

To facilitate purification of the HCV mosaic proteins of the invention, the nucleic acids that encode the protein can also include a coding sequence for an epitope or "tag" for which an affinity binding reagent is available. Examples of suitable epitopes include the myc and V-5 reporter genes; expression vectors useful for recombinant production of fusion polypeptides having these epitopes are commercially available (e.g., Invitrogen (Carlsbad Calif.) vectors pcDNA3.1/Myc-His and pcDNA3.1/V5-His are suitable for expression in mammalian cells).

Additional expression vectors suitable for attaching a tag to the mosaic proteins of the invention, and corresponding detection systems are known to those of skill in the art, and several are commercially available (e.g., FLAG" (Kodak, Rochester N.Y.). Another example of a suitable tag is a polyhistidine sequence, which is capable of binding to metal chelate affinity ligands. Typically, six adjacent histidines are used, although one can use more or less than six. Suitable metal chelate affinity ligands that can serve as the binding moiety for a polyhistidine tag include nitrilo-tri-acetic acid (NTA) (Hochuli, E. (1990) "Purification of recombinant proteins with metal chelating adsorbents" In Genetic Engineering: Principles and Methods, J. K. Setlow, Ed., Plenum Press, NY; commercially available from Qiagen (Santa Clarita, Calif.)).

Polynucleotides Encoding HCV Mosaic Proteins

The invention further provides nucleic acid molecules comprising a polynucleotide encoding an HCV mosaic protein. Such polynucleotides may be designed from the amino acid sequences of the HCV mosaic proteins provided herein. HCV mosaic protein-encoding polynucleotides are preferably generated by chemical synthesis, but other methods may be used, such as various nucleic acid amplification and targeted mutagenesis strategies, as is well know in the art.

The HCV mosaic protein-encoding polynucleotides and nucleic (acid molecules comprising the same) may be used to generate the mosaic proteins of the invention in recombinant expression systems, as described, supra.

The invention further provides vectors containing polynucleotides encoding the mosaic proteins and polypeptides of the invention, as well as host cells transformed or transfected with, or otherwise made to contain, such vectors. Also provided is a recombinant nucleic acid molecule, which includes at least one polynucleotide encoding an HCV mosaic protein operatively linked to one or more other polynucleotides. The one or more other polynucleotides can be, for example, a transcription regulatory element such as a promoter or polyadenylation signal sequence, or a translation regulatory element such as a ribosome binding site. Such a recombinant nucleic acid molecule can be contained in a vector, which can be an expression vector, and the nucleic acid molecule or the vector can be contained in a host cell. A vector of the invention will generally contain various elements required for replication in a prokaryotic or eukaryotic host system, or both, as required. Such vectors, which include plasmid vectors and viral vectors such as bacteriophage, baculovirus, retrovirus, lentivirus, adenovirus, vaccinia virus, semliki forest virus and adeno-associated virus vectors, are well known and can be purchased from a number of commercial sources or constructed using methods well known in the art.

HCV Mosaic Nucleic Acid Vaccines

In another aspect of the invention, nucleic acid molecules comprising expressible polynucleotides encoding HCV mosaic proteins (expression constructs) may be formulated and utilized as DNA vaccine preparations. Such HCV mosaic DNA vaccines may be used to activate HCV-specific T cells, using standard gene delivery protocols. Methods for gene delivery are known in the art. See, e.g., U.S. Pat. Nos. 5,399, 346, 5,580,859, 5,589,466, incorporated by reference herein in their entireties. Genes can be delivered either directly to the vertebrate subject or, alternatively, delivered ex vivo, to cells derived from the subject and the cells reimplanted in the subject. For example, the constructs can be delivered as plasmid DNA, e.g., contained within a plasmid, such as pBR322, pUC, or ColE1.

DNA vaccines may be introduced by a number of different methods, including by injection of DNA in saline, using a standard hypodermic needle. Injection in saline is normally conducted intramuscularly in skeletal muscle, or intradermally, with DNA being delivered to the extracellular spaces. This can be assisted by electroporation, by temporarily damaging muscle fibres with myotoxins such as bupivacaine or by using hypertonic solutions of saline or sucrose. Immune responses to this method of delivery can be affected by many factors, including needle type, needle alignment, speed of injection, volume of injection, muscle type, and age, sex and physiological condition of the individual being injected.

Gene gun delivery ballistically accelerates plasmid DNA (pDNA) that has been adsorbed onto gold or tungsten microparticles into the target cells, using compressed helium as an accelerant. Alternative delivery methods include aerosol instillation of naked DNA on mucosal surfaces, such as the nasal and lung mucosa, and topical administration of pDNA to the eye and vaginal mucosa. Mucosal surface delivery has also been achieved using cationic liposome-DNA preparations, biodegradable microspheres, attenuated *Shigella* or *Listeria* vectors for oral administration to the intestinal mucosa, and recombinant adenovirus vectors.

The method of delivery determines the dose of DNA required to raise an effective immune response. Saline injections require variable amounts of DNA, from 10 µg-1 mg, whereas gene gun deliveries require 100 to 1000 times less DNA than intramuscular saline injection to raise an effective immune response. Generally, 0.2 µg-20 µg are required, although quantities as low as 16 ng have been utilized. Saline injections require more DNA because the DNA is delivered to the extracellular spaces of the target tissue (typically, muscle tissue), where physical barriers such as the basal lamina and large amounts of connective tissue must be overcome before it is taken up by the cells, while gene gun deliveries bombard DNA directly into the cells. For a recent review of DNA vaccines, see: Robinson and Pertmer, 2000, *DNA vaccines for viral infections*, Adv Virus Res 55: 1-74.

HCV mosaic protein expression constructs may be packaged in liposomes prior to delivery to cells. Lipid encapsulation is generally accomplished using liposomes which are able to stably bind or entrap and retain nucleic acid. The ratio of condensed DNA to lipid preparation can vary but will generally be around 1:1 (mg DNA:micromoles lipid), or more of lipid. For a review of the use of liposomes as carriers for delivery of nucleic acids, see, Hug and Sleight, Biochim. Biophys. Acta. (1991) 1097:1-17; Straubinger et al., in Methods of Enzymology (1983), Vol. 101, pp. 512-527.

Liposomal preparations for use with the present invention include cationic (positively charged), anionic (negatively charged) and neutral preparations, with cationic liposomes particularly preferred. Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Feigner et al., Proc. Natl. Acad. Sci. USA (1987) 84:7413-7416). Other commercially available lipids include transfectace (DDAB/DOPE) and DOTAP/DOPE (Boerhinger). Other cationic liposomes can be prepared from readily available materials using techniques well known in the art. See, e.g., Szoka et al., Proc. Natl.

A number of viral based systems have been developed for gene transfer into mammalian cells. For example, retroviruses provide a convenient platform for gene delivery systems, such as murine sarcoma virus, mouse mammary tumor virus, Moloney murine leukemia virus, and Rous sarcoma virus. A selected gene can be inserted into a vector and packaged in retroviral particles using techniques known in the art. The recombinant virus can then be isolated and delivered to cells of the subject either in vivo or ex vivo. A number of retroviral systems have been described.

The HCV mosaic protein expression constructs may also be encapsulated, adsorbed to, or associated with, particulate carriers. Such carriers present multiple copies of a selected molecule to the immune system and promote trapping and retention of molecules in local lymph nodes. The particles can be phagocytosed by macrophages and can enhance antigen presentation through cytokine release. Examples of particulate carriers include those derived from polymethyl methacrylate polymers, as well as microparticles derived from poly(lactides) and poly(lactide-co-glycolides), known as PLG. See, e.g., Jeffery et al., 1993, Pharm. Res. 10:362-368.

Evaluating HCV Mosaic Vaccine Performance

The ability of a particular mosaic protein or vaccine composition to stimulate a cell-mediated immunological response may be determined by a number of assays, such as by lymphoproliferation (lymphocyte activation) assays, CTL cytotoxic cell assays, or by assaying for T-lymphocytes specific for the antigen in a sensitized subject. Such assays are well known in the art (Erickson et al., 1993, J. Immunol. 151:4189-4199; Doe et al., 1994, Eur. J. Immunol. 24:2369-2376). Thus, an immunological response may be one which stimulates the production of CTLs and/or the production or activation of helper T-cells. The antigen of interest may also elicit an antibody-mediated immune response. Hence, an immunological response may include one or more of the following effects: the production of antibodies by B-cells and/or the activation of suppressor T-cells.

Various means for estimating or actually measuring the protective immune response generated by an HCV mosaic vaccine preparation of the invention may be utilized, including without limitation, in silico analytical methods designed to determine the degree of T-cell epitope coverage provided by a particular mosaic protein or combination thereof, and in vivo methods of evaluating the HCV mosaic vaccine preparations of the invention in animal models, including chimpanzees. Recently, a mouse model of HCV infection was described, and may be useful in evaluating the potential efficacy of the HCV mosaic vaccines of the invention (Ploss et al., 2009, Nature 457: 882-886). In the Examples which follow, in silico analysis of 9-mer T-cell epitope coverage within the sequence(s) of single mosaic proteins or multivalent cocktails may be used to determine the likely coverage for all possible 9-mer epitopes.

Epitopes recognized by a T cell receptor on an HCV-activated T cell can be identified by, for example, a Chromium-51 release assay or by a lymphoproliferation assay, as is well known in the art. In a $^{51}$Cr release assay, target cells that display the epitope of interest are prepared by cloning a polynucleotide encoding the epitope into an expression vector and transforming the expression vector into the target cells.

Vaccine Formulations and Administration

The HCV mosaic vaccine polynucleotide and polypeptide compositions described herein may be administered to a subject using any suitable delivery means. Methods of delivering nucleic acids into host cells are discussed above. Further, HCV polynucleotides and/or polypeptides may be administered parenterally, by injection, subcutaneously, intramuscularly, transdermally or transcutaneously. Certain adjuvants, e.g. LTK63, LTR72 or PLG formulations, can be administered intranasally or orally. Additional formulations which are suitable for other modes of administration include suppositories. For suppositories, traditional binders and carriers can include, for example, polyalkylene glycols or triglycerides; such suppositories can be formed from mixtures containing the active ingredient in the range of 0.5% to 10%, preferably 1%-2%. Other oral formulations include such normally employed excipients as, for example, pharmaceutical grades of mannitol, lactose, starch, magnesium stearate, sodium saccharine, cellulose, magnesium carbonate, and the like. These compositions take the form of solutions, suspensions, tablets, pills, capsules, sustained release formulations or powders and contain 10%-95% of active ingredient, preferably 25%-70%.

The HCV mosaic vaccines of the invention are typically prepared as injectables, either as liquid solutions or suspensions. Solid forms suitable for solution or suspension in liquid prior to injection may also be prepared. Such preparations may also be emulsified, or encapsulated in liposomes. Preferably, the vaccine also comprises a pharmaceutically acceptable carrier, which should not itself induce an immune response. Pharmaceutically acceptable carriers are well known to those in the art, and include without limitation large, slowly metabolized macromolecules, such as proteins, polysaccharides, functionalized sepharose, agarose, cellulose, cellulose beads and the like, polylactic acids, polyglycolic acids, polymeric amino acids such as polyglutamic acid, polylysine, and the like.

The HCV mosaic proteins of the invention may be formulated into the immunogenic compound as neutral or salt forms. Pharmaceutically acceptable salts include the acid addition salts (formed with free amino groups of the peptide) and which are formed with inorganic acids such as, for example, hydrochloric or phosphoric acids, or such organic acids such as acetic, oxalic, tartaric, maleic, and the like. Salts formed with the free carboxyl groups can also be derived from inorganic bases such as, for example, sodium, potassium, ammonium, calcium, or ferric hydroxides, and such organic bases as isopropylamine, trimethylamine, 2-ethylamino ethanol, histidine, procaine, and the like.

Vaccine compositions of the invention may also contain liquids or excipients, such as water, saline, glycerol, dextrose, ethanol, or the like, singly or in combination, as well as substances such as wetting agents, emulsifying agents, or pH buffering agents. Liposomes can also be used as a carrier for a composition of the invention, such liposomes are described above.

Various co-stimulatory molecules may be included in the vaccine preparation or delivery protocol. These molecules may improve immunogen presentation to lymphocytes, and include such proteins as B7-1 or B7-2, and cytokines such as GM-CSF, IL-2, and IL-12. Optionally, adjuvants can also be included in a composition. Various adjuvants may be used, including (1) aluminum salts (alum), such as aluminum hydroxide, aluminum phosphate, aluminum sulfate, etc; (2) oil-in-water emulsion formulations (with or without other specific immunostimulating agents such as muramyl peptides or bacterial cell wall components); (3) saponin adjuvants, or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; (6) detoxified mutants of a bacterial ADP-ribosylating toxin such as a cholera toxin (CT), a pertussis toxin (PT), or an *E. coli* heat-labile toxin (LT); (7) other substances that act as immunostimulating agents to enhance the effectiveness of the composition; and (8) microparticles with adsorbed macromolecules. Various novel adjuvants including toll-like receptor agonists have demonstrated enhanced immunogenicity when applied together with HCV immunogens, and may also be used.

The HCV mosaic vaccine compositions of the invention may be administered in a manner compatible with the dosage formulation, and in such amount as will be prophylactically and/or therapeutically effective. The quantity to be administered, which is generally in the range of 5 micrograms to 250 micrograms of polypeptide per dose, depends on the subject to be treated, capacity of the subject's immune system, and the degree of protection desired. Precise amounts of active ingredient required to be administered may depend on the judgment of the practitioner and can be peculiar to each subject.

Vaccine formulations may be introduced in a single dose schedule, or preferably in a multiple dose schedule. A multiple dose schedule is one in which a primary course of vaccination can be with 1-10 separate doses, followed by other doses given at subsequent time intervals required to maintain and or reinforce the immune response, for example, at 1-4 months for a second dose, and if needed, a subsequent dose(s) after several months.

The course of administration may include polynucleotides and polypeptides, together or sequentially (for example, priming with a polynucleotide composition and boosting with a polypeptide composition). The dosage regimen will also, at least in part, be determined by the need of the individual and be dependent upon the judgment of the practitioner.

EXAMPLES

Example 1

HCV Genotype 1 Optimized Mosaic Vaccine

In this Example, a mosaic HCV vaccine comprising a single mosaic polypeptide optimized for HCV genotype 1 is generated and tested.

Materials and Methods

HCV Sequence Data:

Full-length Hepatitis C sequences were accessed from a database of HCV sequences (Los Alamos Natl. Lab., Los Alamos, N. Mex.). A total of 143 genotype 1a sequences, 229 genotype 1b sequences, 3 genotype 1c sequences, 29 genotype 2 sequences, 7 genotype 3 sequences, 11 genotype 4 sequences, 3 genotype 5 sequences, and 42 genotype 6 sequences were included in the analysis. Genotype 7 was not included as only one sequence was available.

Mosaic Vaccine Design and Epitope Coverage:

Coverage assessment methods for comparing vaccine cocktail candidates calculate the number of perfect 9-mer matches between the vaccine cocktail and a population of interest, and, as slightly mismatched epitopes often retain some cross-reactivity, also calculate partial 8/9 and 7/9 matches. A steady-state co-evolutionary algorithm was utilized (Fischer et al., 2007, Nature Medicine 13(1): 100-106). "Steady-state" refers to generating one new candidate solution at a time, rather than a whole new population at once; and "co-evolutionary" refers to simultaneously evolving several distinct populations that work together to form a complete solution. The input is an unaligned set of natural sequences; a candidate solution is a set of k pseudo-natural "mosaic" sequences, each of which is formed by concatenating sections of natural sequences. The fitness criterion is population coverage, defined as the proportion of all 9-amino-acid sequence fragments (potential epitopes) in the input sequences that are found in the cocktail.

To initialize the genetic algorithm, k populations of n initial candidate sequences are generated by 2-point recombination between randomly selected natural sequences. Because the input natural sequences are not aligned, "homologous" crossover is used: crossover points in each sequence are selected by searching for short matching strings in both sequences; strings of c-1=8, were used where a typical epitope length is c=9. This ensures that the recombined sequences resemble natural proteins: the boundaries between sections of sequence derived from different strains are seamless, the local sequences spanning the boundaries are always found in nature, and the is mosaics are prevented from acquiring large insertions/deletions or unnatural combinations of amino acids. Mosaic sequence lengths fall within the distribution of natural sequence lengths as a consequence of mosaic construction: recombination is only allowed at identical regions, reinforced by an explicit software prohibition against excessive lengths to prevent reduplication of repeat regions. (Such "in frame" insertion of reduplicated epitopes could provide another way of increasing coverage without generating unnatural 9-mers, but their inclusion would create "unnatural" proteins.) Initially, the cocktail contains one randomly chosen "winner" from each population. The fitness score for any individual sequence in a population is the coverage value for the cocktail consisting of that sequence plus the current winners from the other populations. The individual fitness of any sequence in a population therefore depends dynamically upon the best sequences found in the other populations.

Optimization proceeds one population at a time. For each iteration, two "parent" sequences are chosen. The first parent is chosen using "2-tournament" selection: two sequences are picked at random from the current population, scored, and the better one is chosen. This selects parents with a probability inversely proportional to their fitness rank within the population, without the need to actually compute the fitness of all individuals. The second parent is chosen in the same way (50% of the time), or is selected at random from the set of natural sequences. 2-point homologous crossover between the parents is then used to generate a "child" sequence. Any child containing a 9-mer that was very rare in the natural population (found less than 3 times) is rejected immediately. Otherwise, the new sequence is scored, and its fitness is compared with the fitnesses of four randomly chosen sequences from the same population. If any of the four randomly chosen sequences has a score lower than that of the new sequence, it is replaced in the population by the new sequence. Whenever a sequence is encountered that yields a better score than the current population "winner", that sequence becomes the winner for the current population and so is subsequently used in the cocktail to evaluate sequences in other populations. A few such optimization cycles (typically 10) are applied to each population in turn, and this process continues cycling through the populations until evolution stalls (i.e. no improvement has been made for a defined number of generations). At this point, the entire procedure is restarted using newly generated random starting populations, and the restarts are continued until no further improvement is seen.

The algorithm also enables optional inclusion of one or more fixed sequences of interest (for example, a consensus) in the cocktail and will evolve the other elements of the cocktail in order to optimally complement that fixed strain. As these solutions were suboptimal, they are not included here. An additional program selects from the input file the k best natural strains that in combination provide the best population coverage.

Measure of Variability:

Shannon entropy, a diversity measure that incorporates both the number of possible amino acids allowed and their frequency, $$\left(-\sum_{aa} P_i(aa)\log_{10}(P_i(aa))\right)$$

where $P_i(aa)$ is the proportion of each amino acid in column i of a sequence alignment (Korber et al., 1994, J. Virol. 68(10): 6730-6744; Yusim et al., 2002, J. Virol. 76(17): 8757-8768), was calculated for each position in the protein alignment.

Results:

Mosaic HCV proteins designed to maximize coverage of common 9-mer epitopes while minimizing the inclusion of rare epitopes were generated. In this Example, a strategy for designing a single HCV mosaic protein vaccine (k=1) was employed, resulting in the generation of the HCV mosaic protein 8.1 having the amino acid sequences shown in SEQ ID NO: 1 (see Table of Sequences).

Epitope coverage of HCV mosaic vaccine 8.1 was evaluated as to (i) maximum coverage of 9-mers present in genotype 1 sequences (lower graph); (ii) fewest unique and unnatural 9-mers present (upper graph) in comparison to other mosaic sequences and cocktails in FIG. 2A. Exact match coverage of 9-mer epitopes across genotype 1 was about 60%, but nevertheless higher than all natural and consensus genotype 1 sequences evaluated (FIG. 2A).

Example 2

Two-Mosaic HCV Genotype 1 Optimized Vaccine

In this Example, a mosaic HCV vaccine comprising a cocktail of two mosaic polypeptides optimized for HCV genotype 1 were generated and tested. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a cocktail of two HCV mosaic proteins (k=2) was employed, resulting in the generation of the HCV mosaic proteins 11.1 and 11.2, having the amino acid sequences shown in SEQ ID NOS: 2 and 3, respectively (see Table of Sequences).

Epitope coverage of the HCV mosaic vaccine cocktail consisting of mosaic proteins 11.1 and 11.2 was evaluated as to (i) maximum coverage of 9-mers present in genotype 1 sequences (lower graph); (ii) fewest unique and unnatural 9-mers present (upper graph) in comparison to other mosaic sequences and cocktails in FIG. 2A. Exact match coverage of 9-mer epitopes across genotype 1 was nearly 80%, higher than the natural and consensus genotype 1 sequences evaluated (FIG. 2A).

Example 3

Three-Mosaic HCV Genotype 1 Optimized Vaccine

In this Example, a mosaic HCV vaccine comprising a cocktail of three mosaic polypeptides optimized for HCV genotype 1 were generated and tested. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a cocktail of three HCV mosaic proteins (k=3) was employed, resulting in the generation of the HCV mosaic proteins 14.1, 14.2 and 14.3, having the amino acid sequences shown in SEQ ID NOS: 4-6, respectively (see Table of Sequences).

Epitope coverage of the HCV mosaic vaccine cocktail consisting of these three mosaic proteins was evaluated as to (i) maximum coverage of 9-mers present in genotype 1 sequences (lower graph); (ii) fewest unique and unnatural 9-mers present (upper graph) in comparison to other mosaic sequences and cocktails in FIG. 2A. Exact match coverage of 9-mer epitopes across genotype 1a and 1b subtypes was greater than 80%, higher than the natural and consensus genotype 1 sequences evaluated (FIG. 2A).

Example 4

Four-Mosaic HCV Genotype 1 Optimized Vaccine

In this Example, a mosaic HCV vaccine comprising a cocktail of four mosaic polypeptides optimized for HCV genotype 1 were generated and tested. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a cocktail of four HCV mosaic proteins (k=4) was employed, resulting in the generation of the HCV mosaic proteins 16.1, 16.2, 16.3 and 16.4, having the amino acid sequences shown in SEQ ID NOS: 7-11, respectively (see Table of Sequences).

Epitope coverage of the HCV mosaic vaccine cocktail consisting of these three mosaic proteins was evaluated as to (i) maximum coverage of 9-mers present in genotype 1 sequences (lower graph); (ii) fewest unique and unnatural 9-mers present (upper graph) in comparison to other mosaic sequences and cocktails in FIG. 2A. Exact match coverage of 9-mer epitopes across genotype 1a and 1b subtypes was greater than 85%, higher than the best natural genotype 1 sequences compared, and slightly higher that the mosaic protein set of Example 3, supra. (FIG. 2A).

Example 5

Mosaic HCV Genotype 1a Optimized Vaccine

In this Example, a mosaic HCV vaccine comprising a single HCV mosaic polypeptide optimized for HCV genotype 1a was generated and tested for cross-coverage with genotype 1b. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a single HCV genotype 1a mosaic protein (k=1) was employed, resulting in the generation of the HCV mosaic protein 17.1, having the amino acid sequence shown in SEQ ID NO: 12 (see Table of Sequences).

Epitope coverage of the HCV mosaic protein 17.1 was evaluated as to (i) maximum coverage of 9-mers present in genotype 1a versus (ii) genotype 1b sequences in comparison to other natural, consensus and mosaic cocktails, as shown in FIG. 2B. Exact match coverage of 9-mer epitopes across genotype 1a approached 80%, but was extremely poor for cross-coverage of genotype 1b (FIG. 2B).

Example 6

Two-Mosaic HCV Genotype 1a Optimized Vaccine

In this Example, a mosaic HCV vaccine comprising a set of two HCV mosaic polypeptides optimized for HCV genotype 1a was generated and tested for cross-coverage with genotype 1b. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a two-mosaic HCV genotype 1a vaccine cocktail (k=2) was employed, resulting in the generation of the HCV mosaic proteins 18.1 and 18.2, having the amino acid sequences shown in SEQ ID NOS: 13 and 14, respectively (see Table of Sequences).

Epitope coverage of the HCV mosaic protein cocktail was evaluated as to (i) maximum coverage of 9-mers present in genotype 1a versus (ii) genotype 1b sequences, in comparison to other natural, consensus and mosaic cocktails, as shown in FIG. 2B. Exact match coverage of 9-mer epitopes across genotype 1a exceeded 80%, but was extremely poor for cross-coverage of genotype 1b (FIG. 2B).

Example 7

Three-Mosaic HCV Genotype 1a Optimized Vaccine

In this Example, a mosaic HCV vaccine comprising a set of three HCV mosaic polypeptides optimized for HCV genotype 1a was generated and tested for cross-coverage with genotype 1b. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a three-mosaic HCV genotype 1a vaccine cocktail (k=3) was employed, resulting in the generation of the HCV mosaic proteins 19.1, 19.2 and 19.3, and having the amino acid sequences shown in SEQ ID NOS: 15-17, respectively (see Table of Sequences).

Epitope coverage of the HCV mosaic protein cocktail was evaluated as to (i) maximum coverage of 9-mers present in genotype 1a versus (ii) genotype 1b sequences, in comparison to other natural, consensus and mosaic cocktails, as shown in FIG. 2B. Exact match coverage of 9-mer epitopes across genotype 1a approached 90%, but was extremely poor for cross-coverage of genotype 1b (FIG. 2B).

Example 8

Four-Mosaic HCV Genotype 1a Optimized Vaccine

In this Example, a mosaic HCV vaccine comprising a set of four HCV mosaic polypeptides optimized for HCV genotype 1a was generated and tested for cross-coverage with genotype 1b. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a four-mosaic HCV genotype 1a vaccine cocktail (k=4) was employed, resulting in the generation of the HCV mosaic proteins 20.1, 20.2, 20.3 and 20.4, having the amino acid sequences shown in SEQ ID NOS: 18-21, respectively (see Table of Sequences).

Epitope coverage of the HCV mosaic protein cocktail was evaluated as to (i) maximum coverage of 9-mers present in genotype 1a versus (ii) genotype 1b sequences, in comparison to other natural, consensus and mosaic cocktails, as shown in FIG. 2B. Exact match coverage of 9-mer epitopes across genotype 1a exceeded 90%, but was relatively poor for cross-coverage of genotype 1b (less than 50%) (FIG. 2B).

Example 9

Mosaic HCV Genotype 1b Optimized Vaccine

In this Example, a mosaic HCV vaccine comprising a single HCV mosaic polypeptide optimized for HCV genotype 1b was generated and tested for cross-coverage with genotype 1a. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a single HCV genotype 1b mosaic protein (k=1) was employed, resulting in the generation of the HCV mosaic protein 21.1, having the amino acid sequence shown in SEQ ID NO: 22 (see Table of Sequences).

Epitope coverage of the HCV mosaic protein 21.1 was evaluated as to (i) maximum coverage of 9-mers present in genotype 1b versus (ii) genotype 1a sequences in comparison to other natural, consensus and mosaic cocktails, as shown in FIG. 2B. Exact match coverage of 9-mer epitopes across genotype 1b was about 75%, but was extremely poor for cross-coverage of genotype 1a (FIG. 2B).

Example 10

Two-Mosaic HCV Genotype 1b Optimized Vaccine

In this Example, a mosaic HCV vaccine comprising a set of two HCV mosaic polypeptides optimized for HCV genotype 1b was generated and tested for cross-coverage with genotype 1a. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a two-mosaic HCV genotype 1b vaccine cocktail (k=2) was employed, resulting in the generation of the HCV mosaic proteins 22.1 and 22.2, having the amino acid sequences shown in SEQ ID NOS: 23 and 24, respectively (see Table of Sequences).

Epitope coverage of the HCV mosaic protein cocktail was evaluated as to (i) maximum coverage of 9-mers present in genotype 1b versus (ii) genotype 1a sequences, in comparison to other natural, consensus and mosaic cocktails, as shown in FIG. 2B. Exact match coverage of 9-mer epitopes across genotype 1b exceeded 80%, but was extremely poor for cross-coverage of genotype 1a (FIG. 2B).

Example 11

Three-Mosaic HCV Genotype 1b Optimized Vaccine

In this Example, a mosaic HCV vaccine comprising a set of three HCV mosaic polypeptides optimized for HCV genotype 1b was generated and tested for cross-coverage with genotype 1a. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a three-mosaic HCV genotype 1b vaccine cocktail (k=3) was employed, resulting in the generation of the HCV mosaic proteins 23.1, 23.2 and 23.3, and having the amino acid sequences shown in SEQ ID NOS: 25-27, respectively (see Table of Sequences).

Epitope coverage of the HCV mosaic protein cocktail was evaluated as to (i) maximum coverage of 9-mers present in genotype 1b versus (ii) genotype 1a sequences, in comparison to other natural, consensus and mosaic cocktails, as shown in FIG. 2B. Exact match coverage of 9-mer epitopes across genotype 1b exceeded 80%, but was extremely poor for cross-coverage of genotype 1a (FIG. 2B).

Example 12

Four-Mosaic HCV Genotype 1b Optimized Vaccine

In this Example, a mosaic HCV vaccine comprising a set of four HCV mosaic polypeptides optimized for HCV genotype 1b was generated and tested for cross-coverage with genotype 1a. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a four-mosaic HCV genotype 1a vaccine cocktail (k=4) was employed, resulting in the generation of the HCV mosaic proteins 24.1, 24.2, 24.3 and 24.4, having the amino acid sequences shown in SEQ ID NOS: 28-31, respectively (see Table of Sequences).

Epitope coverage of the HCV mosaic protein cocktail was evaluated as to (i) maximum coverage of 9-mers present in genotype 1b versus (ii) genotype 1a sequences, in comparison to other natural, consensus and mosaic cocktails, as shown in FIG. 2B. Exact match coverage of 9-mer epitopes across genotype 1b was about 85%, but was relatively poor for cross-coverage of genotype 1b (about 50%) (FIG. 2B).

Example 13

Mosaic HCV Genotype 1a/1b Optimized Vaccine

In this Example, a mosaic HCV vaccine comprising a single HCV mosaic polypeptide optimized for HCV genotypes 1a and 1b was generated and tested for coverage of each of the subtypes. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a single HCV mosaic protein (k=1) optimized for both genotype 1 subtypes 1a and 1b was employed, resulting in the generation of the HCV mosaic protein 25.1, having the amino acid sequence shown in SEQ ID NO: 32 (see Table of Sequences).

Epitope coverage of the HCV mosaic protein 25.1 was evaluated as to maximum coverage of 9-mers present in both subtypes, in comparison to other mosaics, as shown in FIG. 2B.

Example 14

Two-Mosaic HCV Genotype 1a/1b Optimized Vaccine

In this Example, a mosaic HCV vaccine comprising a set of two HCV mosaic polypeptides optimized for HCV genotypes 1a and 1b was generated and tested for coverage of each of the subtypes. HCV sequences, and design and evaluation methods were as described in Example 1.

Results:

Mosaic HCV proteins designed to maximize coverage of common 9-mer epitopes while minimizing the inclusion of rare epitopes were generated. In this Example, a strategy for designing a two-mosaic HCV vaccine cocktail (k=2) optimized for both genotype 1 subtypes 1a and 1b was employed, resulting in the generation of the HCV mosaic proteins 26.1 and 26.2, having the amino acid sequences shown in SEQ ID NOS: 33 and 34, respectively (see Table of Sequences).

Epitope coverage of the HCV mosaic protein cocktail was evaluated as to maximum coverage of 9-mers present in both subtypes, in comparison to other mosaics, as shown in FIG. 2B. Exact match coverage of 9-mer epitopes across genotype 1a exceeded 80%, but was slightly lower for coverage of genotype 1b (FIG. 2B).

Example 15

Three-Mosaic HCV Genotype 1a/1b Optimized Vaccine

In this Example, a mosaic HCV vaccine comprising a set of three HCV mosaic polypeptides optimized for HCV genotypes 1a and 1b was generated and tested for coverage of each of the subtypes. HCV sequences, and design and evaluation methods were as described in Example 1.
Results:

Mosaic HCV proteins designed to maximize coverage of common 9-mer epitopes while minimizing the inclusion of rare epitopes were generated. In this Example, a strategy for designing a three-mosaic HCV vaccine cocktail (k=3) optimized for both genotype 1 subtypes 1a and 1b was employed, resulting in the generation of the HCV mosaic proteins 27.1, 27.2 and 27.3, and having the amino acid sequences shown in SEQ ID NOS: 35-37, respectively (see Table of Sequences).

Epitope coverage of the HCV mosaic protein cocktail was evaluated as to maximum coverage of 9-mers present in both subtypes, in comparison to other mosaics, as shown in FIG. 2B. Exact match coverage of 9-mer epitopes across both subtypes was about the same and exceeded 80% (FIG. 2B).

Example 16

Four-Mosaic HCV Genotype 1a/1b Optimized Vaccine

In this Example, a mosaic HCV vaccine comprising a set of four HCV mosaic optimized for HCV genotypes 1a and 1b was generated and tested for coverage of each of the subtypes. HCV sequences, and design and evaluation methods were as described in Example 1.
Results:

Mosaic HCV proteins designed to maximize coverage of common 9-mer epitopes while minimizing the inclusion of rare epitopes were generated. In this Example, a strategy for designing a four-mosaic HCV vaccine cocktail (k=4) optimized for both genotype 1 subtypes 1a and 1b was employed, resulting in the generation of the HCV mosaic proteins 28.1, 28.2, 28.3 and 28.4, having the amino acid sequences shown in SEQ ID NOS: 38-41, respectively (see Table of Sequences).

Epitope coverage of the HCV mosaic protein cocktail was evaluated as to maximum coverage of 9-mers present in both subtypes, in comparison to other mosaics, as shown in FIG. 2B. Exact match coverage of 9-mer epitopes across both subtypes was about the same and averaged about 85% (FIG. 2B), representing a significant improvement over the three-mosaic protein combination optimized for both subtypes (see Example 15, supra).

Example 17

Serially-Optimized Three-Mosaic Genotype 1 Vaccine

In this Example, a mosaic HCV vaccine comprising a set of three HCV mosaic polypeptides serially optimized for HCV genotypes 1a, 1b and 1c was generated and tested for cross-coverage with genotypes 1a and 1b.
Materials and Methods:

Since only 3 genotype 1c full genome sequences were available, compared to 104 1b and 69 1a sequences (FIG. 2B), a "serial optimization" protocol was adopted, in which one mosaic was optimized for subtype 1b, then a second mosaic optimized for subtype 1a while taking the presence of the 1b-optimized mosaic in the cocktail into account, then a third mosaic optimized for subtype 1c, taking the presence of both other mosaics in the cocktail into account (FIG. 2C). Analogously, a fourth serially optimized strain was optimized on the whole set of genotype 1 sequences (strategy 30).
Results:

Mosaic HCV proteins designed to maximize coverage of common 9-mer epitopes while minimizing the inclusion of rare epitopes were generated. In this Example, a strategy for designing a three-mosaic HCV vaccine cocktail (k=3) optimized for both genotype 1 subtypes 1a, 1b and 1c was employed, resulting in the generation of the HCV mosaic proteins 29.1, 29.2 and 29.3, and having the amino acid sequences shown in SEQ ID NOS: 42-44, respectively (see Table of Sequences).

Epitope coverage of the HCV mosaic protein cocktail was evaluated as to maximum coverage of 9-mers present in both subtypes 1a and 1b, in comparison to other mosaics, as shown in FIG. 2B. Exact match coverage of 9-mer epitopes across both subtypes was about the same and exceeded 80% (FIG. 2B), Comparison of trivalent mosaic cocktail of this Example, obtained via regular or serial optimization (FIG. 2C), shows that the coverage of subtypes 1a and 1b is stable with serial optimization, while coverage of the rare subtype 1c improves greatly.

Example 18

Serially-Optimized Four-Mosaic Genotype 1 Vaccine

In this Example, a mosaic HCV vaccine comprising a set of four HCV mosaic serially optimized for HCV genotypes 1a, 1b and 1c was generated and tested for cross-coverage with genotypes 1a and 1b.
Materials and Methods:

Serial optimization was conducted as described in Example 17, supra, further including a fourth serially optimized strain which was optimized on the whole set of genotype 1 sequences.
Results:

Mosaic HCV proteins designed to maximize coverage of common 9-mer epitopes while minimizing the inclusion of rare epitopes were generated. In this Example, a strategy for designing a four-mosaic HCV vaccine cocktail (k=4) optimized for both genotype 1 subtypes 1a, 1b and 1c was employed, resulting in the generation of the HCV mosaic proteins 30.1, 30.2, 30.3 and 30.4, having the amino acid sequences shown in SEQ ID NOS: 45-48, respectively (see Table of Sequences).

Epitope coverage of the HCV mosaic protein cocktail was evaluated as to maximum coverage of 9-mers present in both subtypes 1a and 1b, in comparison to other mosaics, as shown in FIG. 2B. Exact match coverage of 9-mer epitopes across both subtypes was about the same and averaged about 85% (FIG. 2B), representing a modest improvement over the three-mosaic protein combination optimized for both subtypes 1a and 1b (see Example 17, supra). These results were similar to those obtained with same-k sets of mosaics optimized for only the prevalent subtypes 1a and 1b (see Examples 15 and 16).

Comparison of tetravalent mosaic cocktail of this Example, obtained via regular or serial optimization (FIG. 2C), shows that the coverage of subtypes 1a and 1b is stable with serial optimization, while coverage of the rare subtype 1c improves greatly.

Example 19

Pentavalent HCV Mosaic for Global HCV Vaccine

Figure 3:
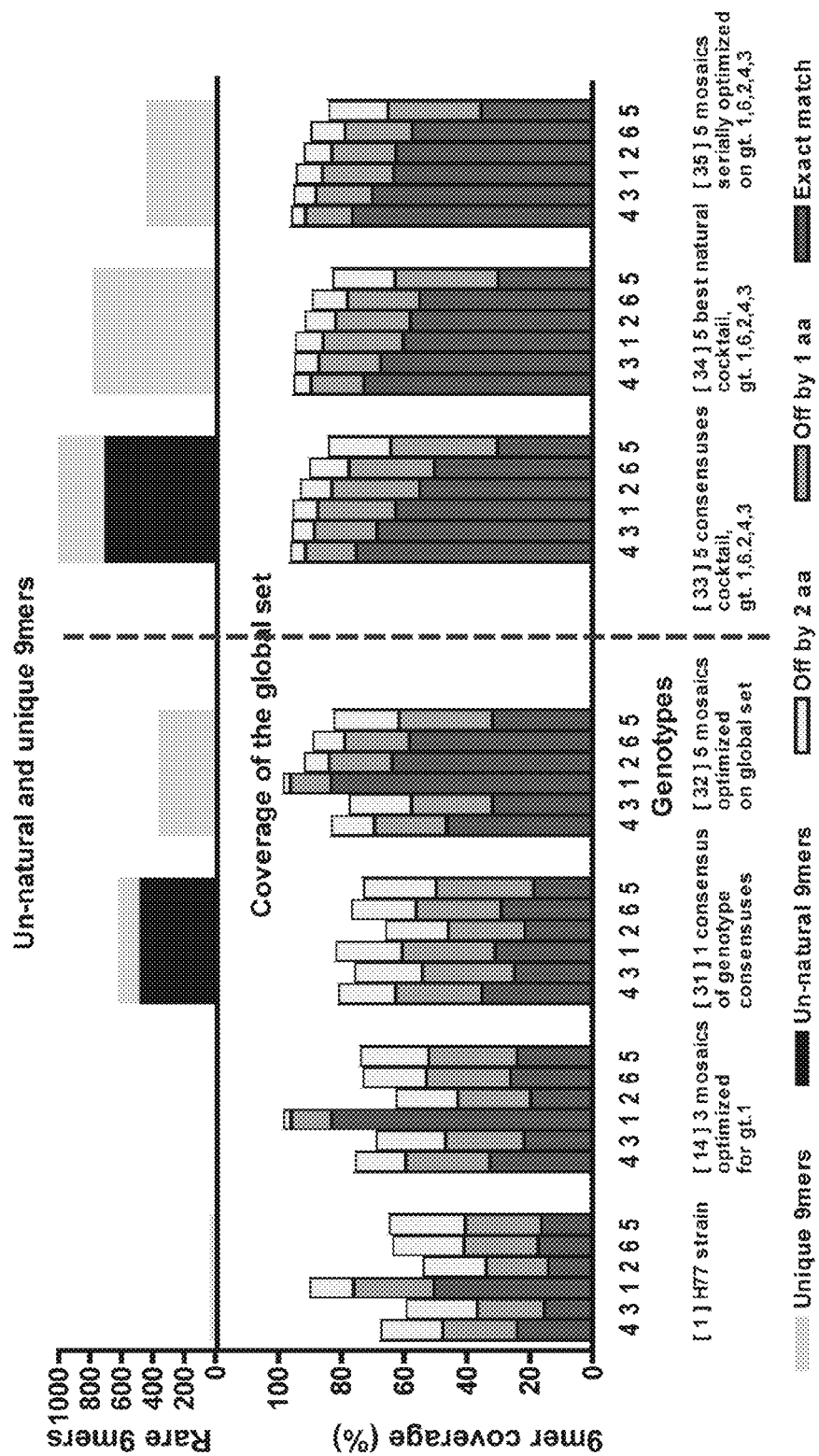
FIG. 3. Comparison of cocktail (and single strain) HCV vaccine candidates for a globally oriented HCV vaccine. Lower portion of the graph: 9-mer coverage of 6 test sets: 375 genotype 1 sequences, 29 genotype 2 sequences, 7 genotype 3 sequences, genotype 11 4 sequences, 3 genotype 5 sequences, and 42 genotype 6 sequences. Upper portion of the graph: number of un-natural and unique 9-mers present in each vaccine candidate.

In this Example, a mosaic HCV vaccine comprising a set of five HCV mosaic proteins optimized across the global HCV sequence set was generated and tested for cross-coverage of the global set. The coverage of the entire 6-genotype target set provided by two genotype 1 oriented vaccine cocktails and 5 new globally oriented vaccine cocktails is shown in FIG. 3. Design and evaluation methods were as described in Example 1.

A set of mosaic proteins 32.1, 32.2, 32.3, 30.4 and 35.5, having the amino acid sequences shown in SEQ ID NOS: 49-53, respectively (see Table of Sequences), was generated and epitope coverage of the HCV mosaic vaccine cocktail was evaluated as to maximum coverage of 9-mers present in genotypes 1-6, in comparison to other mosaics, as shown in FIG. 3.

The H77 sequence provides 50% coverage of genotype 1 but only 14-24% coverage of genotypes 2 through 6. As expected, a trivalent mosaic cocktail optimized for genotype 1 (see Example 3, supra) improves the coverage of genotype 1, but not of the other genotypes. A consensus of genotype consensuses not only provides low coverage of all genotypes, but also has close to 500 un-natural nonamers (FIG. 3).

Example 20

Serially-Optimized Pentavalent Global HCV Vaccine

As shown in Example 19, supra, the five-mosaic cocktail optimized for a global set of natural strains provides very uneven coverage of all genotypes. This is partly due to a bias towards genotypes with more sequences (genotypes 1, 2 and 6). To overcome this bias, 5 genotype consensus sequences (for each of the five genotypes with more than two sequences available), 5 best natural sequences, and 5 mosaics serially optimized for 5 genotypes, respectively, were generated.

Serial optimization was conducted as described in Example 17, except that the optimization sequences was, first genotype 1, then genotype 6, then genotype 2, then genotype 4, then genotype 3.

The 5 mosaic proteins serially optimized for all five genotypes were generated, and have the sequences of SEQ ID NOS: 54-58. Upon evaluation of global HCV strain coverage, this mosaic vaccine cocktail provides some (2-5%) gain compared to the other two, and it contains no un-natural and lowest number of unique nonamers, suggesting it may be the best candidate for a global vaccine (FIG. 3, right of the dashed line).

Example 20

Evaluation of HCV mosaic vaccine cocktails Coverage of Unsampled Circulating HCV In this Example, the impact of expanding the sampling set for determining epitope coverage was assessed across the short and heavily-sequenced 80-100AA "Okamoto region" of the NS5B HCV protein, indicating that performance of the vaccines is almost the same when evaluating coverage across the larger set. There is almost 10 times more sequencing information for this region than for the entire HCV genome (FIG. 5B).

Figure 5:
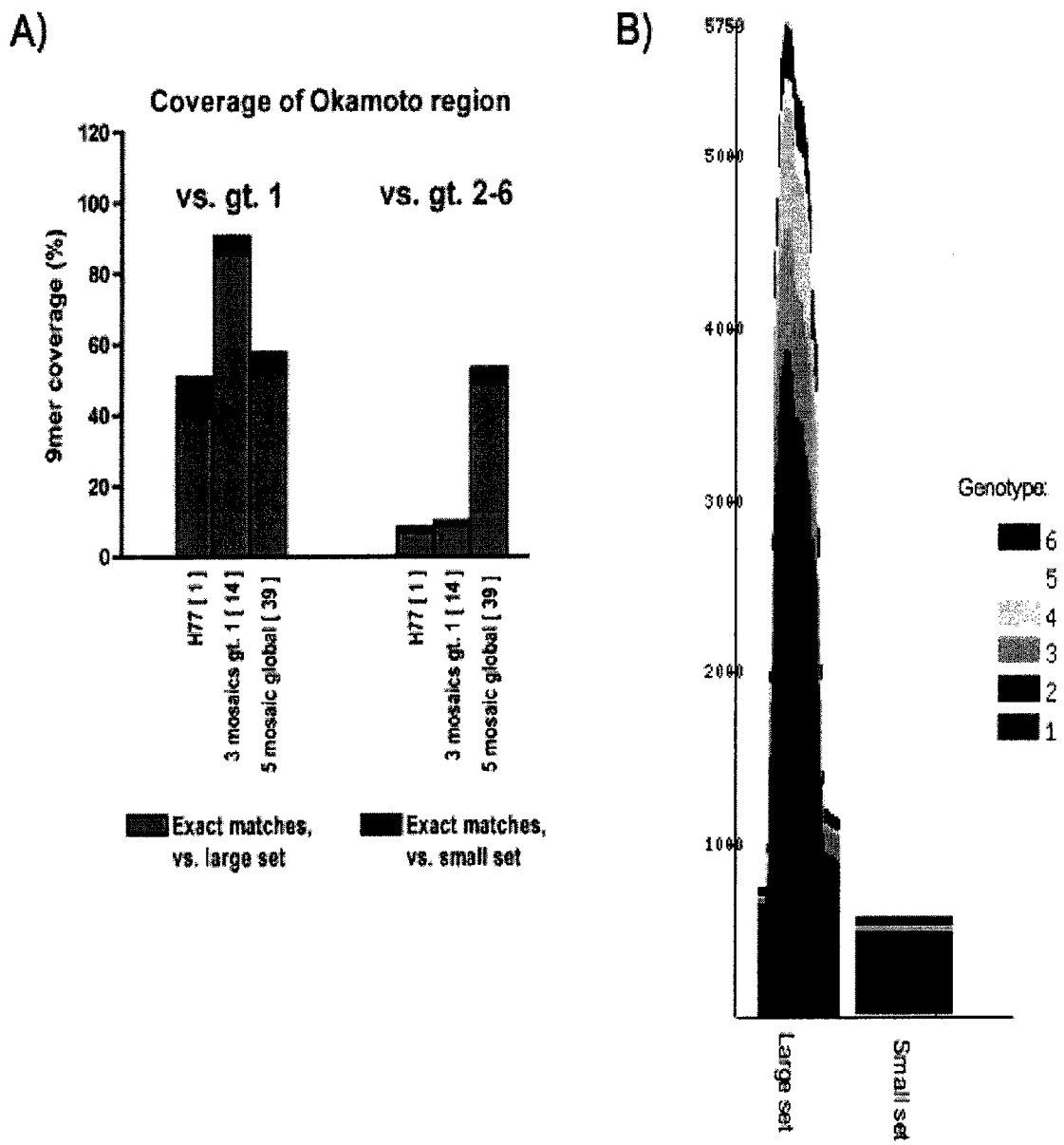
FIG. 5. Coverage of potential vaccines assessed on a large dataset of short sequences. (A) The coverage of the vaccine candidates in FIG. 4 against (i) Okamoto region (positions 8283 to 8609, H77 numbering) sequences taken from the complete genome ("small set", N=375 for genotype 1, N=92 for genotypes 2-6); and (ii) all unrelated HCV database sequences covering the Okamoto region ("large set", N=1983 for genotype 1, N=1887 for genotypes 2-6). (B) The number of and genotype distribution of Okamoto region sequences in the HCV database ("large set"), compared to the entire genome ("small set").

The complete-genome coverage of the mosaic vaccine preparations of Examples 3 and 21 (compared to the natural H77 strain) were evaluated for epitope coverage across all Okamoto region sequences in the Los Alamos HCV database (FIG. 5A).

All considered vaccine cocktails covered the Okamoto sequences (N=1983 for genotype 1, N=1887 for genotypes 2-6) almost as well as the much smaller complete genome set, suggesting that although the vaccine designs are based on a limited set of sequences, good coverage of unstapled circulating viruses can be expected. Since the Okamoto region is quite variable, this comparison provides a conservative estimate of a performance of vaccine based on more conserved regions of genome.

All publications, patents, and patent applications cited in this specification are herein incorporated by reference as if each individual publication or patent application were specifically and individually indicated to be incorporated by reference.

The present invention is not to be limited in scope by the embodiments disclosed herein, which are intended as single illustrations of individual aspects of the invention, and any which are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLE OF SEQUENCES

```
Design8.mosaic1 Amino Acid Sequence
                                         SEQ ID NO: 1
MSTNPKPQRKTKRNTNRRPQDVKFPGGGQIVGGVYLLPRRGPRLGVRATRKT

SERSQPRGRRQPIPKARRPEGRTWAQPGYPWPLYGNEGMGWAGWLLSPRG

SRPSWGPTDPRRRSRNLGKVIDTLTCGFADLMGYIPLVGAPLGGAARALAHGV
```

-continued

```
RVLEDGVNYATGNLPGCSFSIFLLALLSCLTIPASAYEVRNSGVYHVTNDCSN

SSIVYEAADMIMHTPGCVPCVRENNSSRCWVALTPTLAARNASVPTTTIRRHVD

LLVGAAAFCSAMYVGDLCGSVFLVSQLFTFSPRRHETVQDCNCSIYPGHITGHR

MAWDMMMNWSPTTALVVSQLLRIPQAVVDMVAGAHWGVLAGLAYYSMVGN

WAKVLIVMLLFAGVDGHTHVTGGRVASSTQSLVSWLSQGPSQKIQLVNTNGS

WHINRTALNCNDSLQTGFLAALFYVHKFNSSGCPERMASCRPIDEFAQGWGPI

THVVPNISDQRPYCWHYAPRPCGIVPASQVCGPVYCFTPSPVVVGTTDRFGVP

TYSWGENETDVLLLNNTRPPQGNWFGCTWMNSTGFTKTCGGPPCNIGGVGN

NTLTCPTDCFRKHPEATYTKCGSGPWLTPRCLVDYPYRLWHYPCTVNFTIFKV

RMYVGGVEHRLNAACNWTRGERCDLEDRDRSELSPLLLSTTEWQILPCSFTTL

PALSTGLIHLHQNIVDVQYLYGIGSAVVSFAIKWEYVVLLFLLLADARVCACLWM

MLLIAQAEAALENLVVLNAASVAGAFIGILSFLVFFCAAVVYIKGRLVPGAAYALYG

VWPLLLLLLALPPRAYAMDREMAASCGGAVFVGLALLTLSPHYKVFLARLIWWL

QYFITRAEAHLQVWVPPLNVRGGRDAIILLTCAVHPELIFDITKLLLAILGPLMVLQ

AGITRVPYFVRAQGLIRACMLVRKVAGGHYVQMAFMKLAALTGTYVYDHLTPL

RDWAHAGLRDLAVAVEPWFSDMETKIITWGADTAACGDIILGLPVSARRGREIL

LGPADSLEGQGWRLLAPITAYAQQTRGLLGCIITSLTGRDKNQVEGEVQVVSTA

TQSFLATCINGVCWTVYHGAGSKTLAGPKGPITQMYTNVDQDLVGWQAPPGA

RSLTPCTCGSSDLYLVTRHADVIPVRRRGDSRGSLLSPRPISYLKGSSGGPLLC

PSGHAVGIFRAAVCTRGVAKAVDFIPVESMETTMRSPVFTDNSSPPAVPQTFQ

VAHLHAPTGSGKSTKVPAAYAAQGYKVLVLNPSVAATLGFGAYMSKAHGVDPN

IRTGVRTITTGAPITYSTYGKFLADGGCSGGAYDIIICDECHSTDATSILGIGTVLD

QAETAGARLVVLATATPPGSVTVPHPNIEEVALSTTGEIPFYGKAIPIETIKGGRH

LIFCHSKKKCDELAAKLSGLGLNAVAYYRGLDVSVIPTSGDVVVVATDALMTGF

TGDFDSVIDCNTCVTQTVDFSLDPTFTIETTTVPQDAVSRSQRRGRTGRGKPGI

YRFVTPGERPSGMFDSSVLCECYDAGCAWYELTPAETSVRLRAYLNTPGLPVC

QDHLEFWESVFTGLTHIDAHFLSQTKQAGDNFPYLVAYQATVCARAQAPPPSW

DQMWKCLIRLKPTLHGPTPLLYRLGAVQNEVTLTHPITKYIMACMSADLEWTST

VVVLVGGVLAALAAYCLTTGSVVIVGRIILSGKPAIIPDREVLYREFDEMEECASHL

PYIEQGMQLAEQFKQKALGLLQTATKQAEAAAPWESKWRALEAFWAKHMWN

FISGIQYLAGLSTLPGNPAIASLMAFTASITSPLTTQHTLLFNILGGWVAAQLAPP

SAASAFVGAGIAGAAVGSIGLGKVLVDILAGYGAGVAGALVAFKIMSGEVPSTE

DLVNLLPAILSPGALWGWCAAILRRHVGPGEGAVQWMNRLIAFASRGNHVSP

THYVPESDAAARVTQILSSLTITQLLKRLHQWINEDCSTPCSGSWLRDVWDWIC

TVLTDFKTWLQSKLLPRLPGVPFFSCQRGYKGVWRGDGIMQTTCPCGAQITGH

VKNGSMRIVGPKTCSNTWHGTFPINAYTTGPCTPSPAPNYSRALWRVAAEEYV

EVTRVGDFHYVTGMTTDNVKCPCQVPAPEFFTEVDGVRLHRYAPACKPLLREE

VTFQVGLNQYLVGSQLPCEPEPDVAVLTSMLTDPSHITAETAKRRLARGSPPSL

ASSSASQLSAPSLKATCTTHHDSPDADLIEANLLWRQEMGGNITRVESENKVVI

LDSFDPLRAEEDEREVSVPAEILRKSRKFPPALPIWARPDYNPPLLESWKDPDY

VPPWHGCPLPPTKAPPIPPPRRKRTWLTESTVSSALAELATKTFGSSESSAV
```

-continued

DSGTATAPPDQPSDDGDAGSDVESYSSMPPLEGEPGDPDLSDGSWSTVSEE

ASEDVVCCSMSYTWTGALITPCAAEESKLPINALSNSLLRHHNMVYATTSRSAS

QRQKKVTFDRLQVLDDHYRDVLKEMKAKASTVKAKLLSVEEACKLTPPHSARS

KFGYGAKDVRCHARKAVNHINSVWKDLLEDTETPIDTTIMAKNEVFCVQPEKG

GRKPARLIVFPDLGVRVCEKMALYDWSTLPQAVMGSSYGFQYSPGQRVEFLV

NAWKSKKTPMGFSYDTRCFDSTVTESDIRVEESIYQCCDLAPEARQAIRSLTER

LYIGGPLTNSKGQNCGYRRCRASGVLTTSCGNTLTCYLKASAACRAAKLQDCT

MLVCGDDLWICESAGTQEDAASLRVFTEAMTRYSAPPGDPPQPEYDLELITSC

SSNVSVAHDASGKRVYYLTRDPTTPLARAAWETARHTPVNSWLGNIIMYAPTL

WARMILMTHFFSILLAQEQLEKALDCQIYGACYSIEPLDLPQIIQRLHGLSAFSLH

SYSPGEINRVASCLRKLGVPPLRVWRHRARSVRAKLLSQGGRAATCGKYLFN

WAVRTKLKLTPIPAASQLDLSGWFVAGYSGGDIYHSLSRARPRWFMWCLLLLS

VGVGIYLLPNR

Design11.mosaic1 Amino Acid Sequence
                                                    SEQ ID NO: 2
MSTNPKPQRRTKRNTNRRPQDVKFPGGGQIVGGVYLLPRRGPRLGVRAPRKT

SERSQPRGRRQPIPKARRPEGRTWAQPGYPWPLYGNEGMGWAGWLLSPRG

SRPSWGPNDPRRRSRNLGRVIDTLTCGFADLMGYIPLVGAPLGGVARALAHGV

RVLEDGVNYATGNLPGCSFSIFLLALLSCLTVPASAYQVRNSTGLYHVTNDCPN

SSIVYEAADAILHTPGCVPCVREGNASRCWVAVTPTVATRDGKLPTTQLRRHID

LLVGSATLCSALYVGDLCGSVFLVGQLFTFSPRRHWTTQDCNCSIYPGHITGHR

MAWDMMMNWSPTAALVVAQLLRIPQAILDMIAGAHWGVLAGIAYFSMVGNWA

KVLVVLLLFAGVDGHTHVTGGRVASSTQSLVSWLSQGPSQKIQLVNTNGSWHI

NRTALNCNDSLQTGFIAALFYAHRFNASGCPERMASCRPLADFDQGWGPISYA

NGSGPDQRPYCWHYPPKPCGIVPAKSVCGPVYCFTPSPVVVGTTDRSGAPTY

NWGENDTDVFVLNNTRPPLGNWFGCTWMNSSGFTKVCGAPPCVIGGVGNNT

LHCPTDCFRKHPEATYSRCGSGPWITPRCLVDYPYRLWHYPCTINYTIFKVRMY

VGGVEHRLEAACNWTRGERCDLEDRDRSELSPLLLSTTEWQILPCSFTTLPAL

STGLIHLHQNIVDVQYLYGVGSSIASWAIKWEYVVLLFLLLADARVCSCLWMML

ISQAEAALENLVILNAASLAGTHGLVSFLVFFCFAWYLKGRWVPGAVYALYGM

WPLLLLLLALPQRAYALDTEVAASCGGWLVGLMALTLSPYYKRYISWCLWWL

QYFLTRVEAQLHVWVPPLNVRGGRDAVILLMCWHPTLVFDITKLLLAVFGPLWI

LQASLLKVPYFVRVQGLLRICALARKMAGGHYVQMAIIKLGALTGTYVYNHLTPL

RDWAHNGLRDLAVAVEPWFSQMETKLITWGADTAACGDIINGLPVSARRGREI

LLGPADGMVSKGWRLLAPITAYAQQTRGLLGCIITSLTGRDKNQVEGEVQIVST

AAQTFLATCINGVCWTVYHGAGTRTIASPKGPVIQMYTNVDKDLVGWPAPQGA

RSLTPCTCGSSDLYLVTRHADVIPVRRRGDSRGSLLSPRPISYLKGSSGGPLLC

PAGHAVGIFRAAVCTRGVAKAVDFIPVENLETTMRSPVFTDNSSPPAVPQSFQV

AHLHAPTGSGKSTKVPAAYAAQGYKVLVLNPSVAATLSFGAYMSKAHGVDPNI

RTGVRTITTGSPITYSTYGKFLADGGCSGGAYDIIICDECHSTDATSILGIGTVLD

-continued

QAETAGARLVVLATATPPGSITVPHPNIEEVALSTTGEIPFYGKAIPLEVIKGGRH

LIFCHSKKKCDELAAKLVALGINAVAYYRGLDVSVIPTSGDVVVVATDALMTGYT

GDFDSVIDCNTCVIQTVDFSLDPTFTIETTTLPQDAVSRTQRRGRTGRGKPGIYR

FVAPGERPSGMFDSSILCECYDAGCAVVYELTPAETTVRLRAYMNTPGLPVCQD

HLEFWEGVFTGLTHIDAHFLSQTKQSGENLPYLVAYQATVCARAQAPPPSWDQ

MWKCLTRLKPTLHGPTPLLYRLGAVQNEVTLTHPITKYIMTCMSADLEVATSTW

VLVGGVLAALAAYCLSTGCVVIVGRIVLSGKPAIIPDREVLYREFDEMEECSQHL

PYIEQGMMLAEQFKQKALGLLQTASRQAEVIAPAVQTNWQKLEAFWAKHMWN

FISGVQYLAGLSTLPGNPAIASLMAFTAAVTSPLTTSQTLLFNILGGWVAAQLAA

PGAATAFVGAGLAGAAIGSVGLGKVLVDILAGYGAGVAGALVAFKIMSGEVPST

EDLVNLLPAILSPGALVVGVVCAAVLRRHVGPGEGAVQWMNRLIAFASRGNHV

SPTHYVPESDAAARVTAILSSLTVTQLLRRLHQWISSECTTPCSGSWLRDIWDW

ICEVLSDFKTWLKAKLMPQLPGIPFVSCQRGYRGVWRGDGIMHTRCHCGAEIT

GHVKNGTMRIVGPRTCRNMWSGTFPINAYTTGPCTPLPAPNYTFALWRVSAEE

YVEIRQVGDFHYVTGMTTDNLKCPCQVPSPEFFTELDGVRLHRFAPPCKPLLR

EEVSFRVGLHEYPVGSQLPCEPEPDVAVLTSMLTDPSHITAEAAGRRLARGSP

PSVASSSASQLSAPSLKATCTANHDSPDAELIEANLLWRQEMGSNITRVESENK

VVVLDSFDPLVAEEDEREISVPAEILRKSRRFAQALPVWARPDYNPPLLETWKK

PDYEPPVVHGCPLPPPQSPPVPPPRKKRTVVLTESTVSTALAELATKSFGSSST

SGITGDNTTTSSEPAPSGCPPDSDAESYSSMPPLEGEPGDPDLSDGSWSTVS

SGADTEDVVCCSMSYSWTGALVTPCAAEEQKLPINALSNSLLRHHNLVYSTTS

RSACQRQKKVTFDRLQVLDSHYQDVLKEVKAAASKVKANLLSVEEACSLTPPH

SAKSKFGYGAKDVRCHARKAVNHINSVWKDLLEDSVTPIDTTIMAKNEVFCVQP

EKGGRKPARLIVYPDLGVRVCEKMALYDWSKLPLAVMGSSYGFQYSPGQRVE

FLVQAWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAAGLQ

DCTMLVCGDDLVVICESAGVQEDAASLRAFTEAMTRYSAPPGDPPQPEYDLELI

TSCSSNVSVAHDGAGKRVYYLTRDPTTPLARAAWETARHTPVNSWLGNIIMFA

PTLWARMILMTHFFSVLIARDQLEQALDCEIYGACYSIEPLDLPPIIQRLHGLSAF

SLHSYSPGEINRVAACLRKLGVPPLRAWRHRARSVRARLLSRGGRAAICGKYL

FNWAVRTKLKLTPIAAAGQLDLSGWFTAGYSGGDIYHSVSHARPRWFWFCLLL

LAAGVGIYLLPNR

Design11.mosaic2 Amino Acid Sequence
                                          SEQ ID NO: 3
MSTNPKPQRKTKRNTNRRPQDVKFPGGGQIVGGVYLLPRRGPRLGVRATRKT

SERSQPRGRRQPIPKARQPEGRAWAQPGYPWPLYGNEGCGWAGWLLSPRG

SRPSWGPTDPRRRSRNLGKVIDTLTCGLADLMGYIPLVGAPLGGAARALAHGV

RVVEDGVNYATGNLPGCPFSIFLLALLSCLTIPASAYEVRNVSGVYHVTNDCSN

SSIVYEAADMIMHTPGCVPCVRENNSSRCWVALTPTLAARNASVPTTTIRRHVD

LLVGAAAFCSAMYVGDLCGSVFLVSQLFTFSPRRHETVQDCNCSIYPGHVSGH

-continued

RMAWDMMMNWSPTTALWSQLLRIPQAVVDMVAGAHWGVLAGLAYYSMVGN

WAKVLIVMLLFAGVDGGTYVTGGTMAKNTLGITSLFSPGSSQKIQLINTNGSWHI

NSTALNCNDSLNTGFLAALFYTHRFNSSGCPERMASCRPIDKFAQGWGPITHV

VPNISDQRPYCWHYAPRPCGIVPASQVCGPVYCFTPSPWVGTTDRFGVPTYS

WGENETDVLLLNNTRPPQGNWFGCTWMNSTGFTKTCGGPPCNIGGVGNNTL

TCPTDCFRKHPEATYTKCGSGPWLTPRCMVDYPYRLWHYPCTVNFTIFKVRM

YVGGVEHRLNAACNWTRGERCNLEDRDRSELSPLLLSTTQWQVLPCSFTTLP

ALTTGLIHLHQNWDVQYLYGIGSAWSFAIKWEYVLLLFLLLADARVCACLWMM

LLIAQAEAALENLVVLNAASVAGAHGILSFLVFFCAAWYIKGRLVPGAAYALYGV

WPLLLLLLALPPRAYAMDREMAASCGGAVFVGLVLLTLSPHYKVFLARLIWWLQ

YFITRAEAHLQVWIPPLNVRGGRDAIILLTCAVHPELIFDITKLLLAILGPLMVLQA

GITRVPYFVRAQGLIRACMLVRKVAGGHYVQMAFMKLAALTGTYVYDHLTPLR

DWAHAGLRDLAVAVEPWFSDMETKIITWGADTAACGDIILGLPVSARRGKEILL

GPADSLEGQGWRLLAPITAYSQQTRGLLGCIVTSLTGRDRNQVEGEVQWSTA

TQSFLATCVNGVCWTVYHGAGSKTLAGPKGPITQMYTNVDQDLVGWQAPPGA

RSLTPCACGSSDLYLVTRHADVIPVRRRGDGRGSLLSPRPVSYLKGSSGGPLL

CPSGHAVGIFRAAVCTRGVAKAVDFVPVESMETTMRSPVFTDNSSPPAVPQTF

QVAHLHAPTGSGKSTRVPAAYAAQGYKVLVLNPSVAATLGFGAYMSKAHGIDP

NIRTGVRTITTGAPITYSTYGKFLADGGCSGGAYDIIMCDECHSTDSTTILGIGTV

LDQAETAGARLTVLATATPPGSVTVPHPNIEEVALSNTGEIPFYGKAIPIETIKGG

RHLIFCHSRKKCDELAAKLSGLGLNAVAYYRGLDVSVIPASGDVVVVATDALMT

GFTGDFDSVIDCNTCVTQTVDFSLDPTFTIETTTVPQDAVSRSQRRGRTGRGR

RGIYRFVTPGERPSGMFDSSVLCECYDAGCAWYELTPAETSVRLRAYLNTPGL

PVCQDHLEFWESVFTGLTHIDAHFLSQTKQAGDNFPYLVAYQATVCARAQALP

PSWDQMWKCLIRLKPTLHGPTPLLYRLGAVQNEITLTHPITKYIMACMSADLEW

TSTWVLVGGVLAALAAYCLTTGSWIVGRIILSGKPAVIPDREVLYQEFDEMEEC

ASHLPYIEQGMQLAEQFKQKALGLLQTATKQAEAAAPVVESKWRALETFWAKH

MWNFISGIQYLAGLSTLPGNPAIASLMAFTASITSPLTTQHTLLFNILGGWVAAQL

APPSAASAFVGAGIAGAAVGSIGLGKVLVDILAGYGAGVAGALVAFKVMSGEMP

STEDLVNLLPAILSPGALWGWCAAILRRHVGPGEGAVQWMNRLIAFASRGNH

VSPTHYVQESDAAARVTQILSSLTITQLLKRLHQWINEDCSTPCSGSWLRDVWD

WICTVLTDFKTWLQSKLLPRLPGVPFFSCQRGYKGVWRGDGIMQTTCPCGAQI

TGHVKNGSMRIVGPKTCSNTWHGTFPINAYTTGPCTPSPAPNYSRALWRVAAE

EYVEVTRVGDFHYVTGMTTDNVKCPCQVPAPEFFTEVDGVRLHRYAPACKPLL

REEVTFQVGLNQYLVGSQLPCEPEPDVTVLTSMLTDPSHITAETAKRRLARGSP

PSLASSSASQLSAPSLKATCTTRHDSPDADLIEANLLWRQEMGGNITRVESENK

WILDSFDPLRAEEDEREVSVPAEILRKSRKFPPALPIWARPDYNPPLLESWKDP

DYVPPVVHGCPLPPTKAPPIPPPRRKRTVVLTESTVSSALAELATKTFGSSESS

AVDSGTATAPPDQPSDDGDAGSDVESYSSMPPLEGEPGDPDLSDGSWSTVS

EEASEDVVCCSMSYTWTGALITPCAAEESKLPINALSNSLLRHHNMVYATTSRS

-continued

```
ASQRQKKVTFDRLQVLDDHYRDVLKEMKAKASTVKAKLLSVEEACKLTPPHSA

RSKFGYGAKDVRNLSSKAVNHIRSVWKDLLEDTETPIDTTIMAKNEVFVVQPEK

GGRKPARLIVFPDLGVRVCEKMALYDVVSTLPQAVMGSSYGFQYSPKQRVEFL

VNAWKSKKCPMGFAYDTRCFDSTVTENDIRVEESIYQCCDLAPEARQAIRSLTE

RLYIGGPLTNSKGQNCGYRRCRASGVLTTSCGNTLTCYLKASAACRAAKLQDC

TMLVNGDDLVVICESAGTQEDAASLRVFTEAMTRYSAPPGDPPKPEYDLELITS

CSSNVSVAHDASGKRVYYLTRDPTTPIARAAWETARSTPVNSWLGNIIMYAPTL

WARMILMTHFFSILLAQEQLEKALDCQIYGACYSIEPLDLPQIIERLHGLSAFSLH

SYSPGEINRVASCLRKLGVPPLRVWRHRARSVRAKLLSQGGRAATCGKYLFN

WAVKTKLKLTPIPAASQLDLSGWFVAGYSGGDIYHSLSRARPRWFMWCLLLLS

VGVGIYLLPNR
```

Design14.mosaic1 Amino Acid Sequence
SEQ ID NO: 4

```
MSTNPKPQRQTKRNTNRRPQDVKFPGGGQIVGGVYLLPRRGPRLGVRAPRKT

SERSQPRGRRQPIPKARRPEGRAWAQPGYPWPLYGNEGMGWAGWLLSPRG

SRPSWGPNDPRRRSRNLGKVIDTLTCGFADLMGYIPLVGAPLGGAARVLAHGV

RVLEDSVNYATGNLPGCSFSIFLLALLSCLTVPASAYQVRNSTGLYHVTNDCPN

SSIVYEAADAILHTPGCVPCVREGNASRCWVAMTPTVATRDGKLPTTQLRRHID

LLVGSATLCSALYVGDLCGSVFLVGQLFTFSPRRHWTTQDCNCSIYPGHITGHR

MAWDMMMNWSPTTALVVSQLLRIPQAVMDVAGAHWGILAGLAYYSMVGNW

AKVLVVLLLFAGVDAGTHVTGGSAAKDTSGFTSLFRIGARQNIQLINTNGSWHIN

RTALNCNASLDTGWVAGLFYYHKFNSSGCPERMASCRPLADFDQGWGPISYA

NGSGPDQRPYCWHYPPKPCGIVPAKSVCGPVYCFTPSPVVVGTTDRSGAPTY

NWGENDTDVFVLNNTRPPLGNWFGCTWMNSSGFTKVCGAPPCVIGGVGNNT

LHCPTDCFRKHPEATYSRCGSGPWITPRCLVDYPYRLWHYPCTINYTIFKVRMY

VGGVEHRLEAACNWTRGERCDLEDRDRSELSPLLLSTTQWQVLPCSFTPMPA

LSTGLIHLHQNIVDVQYLYGVGSSIASWAIKWEYVVLLFLLLADARVCSCLWMML

LISQVEAALENLVILNAASLAGTHGLVSFLVFFCFAWYLKGRWVPGAVYALYGM

WPLLLLLLALPQRAYALDTEVAASCGGWLVGLMALTLSPYYKRYISWCLWWL

QYFLTRVEAQLHVWVPPLNVRGGRDAVILLMCVVHPTLVFDITKLLLAVFGPLWI

LQASLLKVPYFVRVQGLLRICALARKMAGGHYVQMAIIKLGALTGTYVYNHLTPL

RDWAHNGLRDLAVAVEPWFSQMETKLITWGADTAACGDIINGLPVSARRGREI

LLGPADGMVSKGWRLLAPITAYAQQTRGLLGCIVTSLTGRDKNQVEGEVQIVST

AAQTFLATCINGVCWTVYHGAGTRTIASPKGPVIQMYTNVDKDLVGWPAPQGA

RSLTPCACGSSDLYLVTRHADVIPVRRRGDSRGSLLSPRPVSYLKGSSGGPLL

CPAGHAVGIFRAAVCTRGVAKAVDFIPVENLETTMRSPVFTDNSSPPVVPQSFQ

VAHLHAPTGSGKSTKVPAAYASQGYKVLVLNPSVAATLGFGAYMSKAHGIDPNI

RTGVRTITTGASITYSTYGKFLADGGCSGGAYDIIICDECHSTDSTSILGIGTVLD

QAETAGVRLTVLATATPPGSVTVPHSNIEEVALSTTGEIPFYGKAIPLEVIKGGRH

LIFCHSKKKCDELAAKLVALGVNAVAYYRGLDVSVIPASGDVWVATDALMTGY
```

-continued

```
TGDFDSVIDCNTCVTQSVDFSLDPTFTIETTTLPQDAVSRTQRRGRTGRGKPGI

YRFVAPGERPSGMFDSVVLCECYDAGCAVVYELTPSETTVRLRAYMNTPGLPV

CQDHLEFWESVFTGLTHIDAHFLSQTKQSGENFPYLVAYQATVCARAQALPPS

WDQMWKCLVRLKPTLHGPTPLLYRLGAVQNEVTLTHPVTKYIMTCMSADLEVV

TSTWVLVGGVLAALAAYCLSTGCVVIVGRIVLSGKPAIIPDREVLYREFDEMEEC

SQHLPYIEQGMALAEQFKQKALGLLQTASRQAEVIAPAVQTNWQKLEAFWAKH

MWNFISGIQYLAGLSTLPGNPAIASLMAFTAAVTSPLTTSQTLLFNILGGWLAAQ

LAAPGAATAFVGAGLAGAAIGSVGLGKVLVDILAGYGAGVAGALVAFKVMSGD

MPSTEDLVNLLPAILSPGALWGVVCAAILRRHVGPGEGAVQWMNRLIAFASRG

NHVSPTHYVPESDAAARVTTILSSLTVTQLLRRLHQWISSESTTPCSGSWLKDV

WDWICTVLSDFKTWLQSKLLPRLPGVPFFSCQRGYKGVWRGDGIMHTTCPCG

AQITGHVKNGSMRIVGPRTCSNTWHGTFPINAYTTGPCTPSPAPNYSRALWRV

AAEEYVEVTRVGDFHYVTGMTTDNIKCPCQVPAPEFFTELDGVRLHRYAPACK

PLLREEVTFQVGLNQYLVGSQLPCEPEPDVTVVTSMLTDPSHITAEAARRRLAR

GSPPSVASSSASQLSAPSLKATCTTHHDSPDADLIEANLLWRQEMGSNITRVES

ENKWILDSFEPLRAEEDEREVSVAAEILRKSRKFPPALPVWARPDYNPPLIESW

KDPDYVPPVVHGCPLPPTKAPPIPPPRRKKTVVLTESTVSSALAELATKTFGSS

GSSAVDSGTATAPPDQPSDDGDAGSDVESYSSMPPLEGEPGDPDLSDGSWS

TVSEEASEDVVCCSMSYSWTGALITPCAAEESKLPINALSNSLLRHHNMVYATT

SRSASQRQKKVTFDRLQVLDNHYQDVLKEMKAKASTVKAKLLSVEEACKLTPP

HSARSKFGYGAKDVRNLSSKAVNHIRSVWKDLLEDTETPIDTTIMAKSEVFCVQ

PEKGGRKPARFIVFPDLGVRVCEKMALYDVVSTLPQAVMGSSYGFQYSPKQR

VEFLVNTWKSKKCPMGFSYDTRCFDSTVTESDIRVEESIYQCCDLAPEARQAIR

SLTERLYIGGPLTNSKGQSCGYRRCRASGVLTTSCGNTLTCYLKASAACRAAKL

QDCTMLVNGDDLVVICESAGTQEDAASLRVFTEAMTRYSAPPGDLPQPEYDLE

LITSCSSNVSVAHDATGKRVYYLTRDPTTPLARAAWETARHTPVNSWLGNIIMF

APTLWVRMILMTHFFSILLAQEQLEKALDCQIYGATYSIEPLDLPQIIQRLHGLSA

FSLHSYSPGEINRVASCLRKLGVPPLRVWRHRARSVRAKLLSQGGRAAICGRY

LFNWAVRTKLKLTPIPAASQLDLSGWFVAGYSGGDIYHSLSRARPRWFMWCLL

LLSVGVGIYLLPNR

Design14.mosaic2 Amino Acid Sequence
                                                 SEQ ID NO: 5
MSTNPKPQRKIKRNTNRRPQDVKFPGGGQIVGGVYLLPRRGPRLGVRTTRKTS

ERSQPRGRRQPIPKARRPEGRTWAQPGYPWPLYGNEGCGWAGWLLSPRGS

RPSWGPSDPRRRSRNLGKVIDTLTCGFADLMGYIPLVGAPLGGAARALAHGVR

VLEDGVNYATGNLPGCSFSIFLLALLSCLTIPASAYEVRNASGVYHVTNDCSNSS

IVYEAADVIMHTPGCVPCVREGNSSRCWVALTPTLAARNSSIPTTTIRRHVDLLV

GAAALCSAMYVGDLCGSVFLVSQLFTFSPRRYETVQDCNCSIYPGHVSGHRM

AWDMMMNWSPTTALWAQLLRIPQAILDMIAGAHWGVLAGIAYFSMVGNWAK

VIVVLLLFAGVDGNTRVSGGEAAKNTMGFASLFVSGPSQKIQLINTNGSWHINR
```

-continued

```
TALNCNDSLQTGFLAALFYAHKFNASGCPERMASCRPIDEFAQGWGPITHVVP
NISDQRPYCWHYAPRPCGIVPASQVCGPVYCFTPSPVVVGTTDRSGVPTYTW
GENETDVLILNNTRPPRGNWFGCTWMNSTGFTKTCGGPPCNIGGAGNNTLICP
TDCFRKHPEATYARCGSGPWLTPRCMVDYPYRLWHYPCTVNYTLFKVRMYVG
GVEHRLNAACNWTRGERCDLDDRDRSELSPLLLSTTEWQILPCSFTTLPALTT
GLIHLHQNIVDVQYLYGVGSSIVSWAIKWEYVILLFLLLADARICSCLWMMLLISQ
AEAALENLVLLNAASLAGVHGILSFLVFFCAAVVYIKGRLVPGAAYAFYGVWPLLL
LLMALPARAYAMDREMAASCGGAVFVGLVLLTLSPYYKVFLAKLIWWLQYLITR
AEAHLQVWVPPLNVRGGRDAIILLTCAVHPELIFDITKLLLAILGPLMVLQAGITRV
PYFVRAQGLIRACMLVRKAAGGHYVQMAFMKLAALTGTYVYDHLTPLQDWAH
TGLRDLAVAVEPVIFSDMETKIITWGADTAACGDIISGLPVSARRGKEILLGPADS
FGEQGWRLLAPITAYSQQTRGLLGCIITSLTGRDKNQVEGEVQMVSTATQSFLA
TCINGACWTVYHGAGSKTLAGPKGPITQMYTNVDQDLVGWPAPPGARSMTPC
TCGSSDLYLVTRHADVIPVRRRGDTRGSLLSPRPISYLKGSSGGPLLCPSGHVV
GIFRAAVCTRGVAKAVDFIPVESLETTMRSPVFTDNSSPPAVPQSFQVAYLHAP
TGSGKSTKVPAAYAAQGYTVLVLNPSVAATLSFGAYMSKAHGVDPNIRTGVRTI
TTGSPITYSTYGKFLADGGCSGGAYDIIMCDECHSTDATSILGIGTALDQAETAG
ARLVVLATATPPGSITVPHPNIEEVALSNTGEIPFYGKAIPLEAIKGGRHLIFCHSK
RKCDELAAKLVALGINAVAYYRGLDVSVIPTSGNVVVVATDALMTGFTGDFDSVI
DCNTCVTQTVDFSLDPTFTIETTTVPQDAVSRTQRRGRTGRGRRGIYRFVTPG
ERPSGMFDSSVLCECYDAGCAVVYELTPAETSVRLRAYLNTPGLPVCQDHLEF
WEGVFTGLTRIDAHFLSQTKQAGDNFPYLVAYQATVCARSQAPPPSWDQMWK
CLIRLKPTLHGATPLLYRLGAVQNEITLTHPITKYIMACMSADLEVVTSTWVLVG
GVLAALAAYCLTTGCVVIVGRVVLSGKPAIVPDREVLYRQFDEMEECSQHLPYI
EQGMMLAEQFKQKALGLLQTATKQAEAAAPMVESKWRALETFWAKHMWNFIS
GVQYLAGLSTLPGNPAIASLMAFTASVTSPLTTQSTLLFNILGGWVAAQLAPPSA
ASAFVGAGIAGAAVGSIGLGKVLVDVLAGYGAGVAGALVAFKVMSGEMPSTED
LVNLLPAILSPGALVVGVVCAAILRRHVGPGEGAVQWMNRLIAFASRGNHVSPT
HYVPESDAAARVTQILSSLTITQLLKRLHQWINEDCSTPCSGSWLRDVWDWICT
VLTDFKTWLQSKLMPRLPGVPFLSCQRGYKGVWRGDGIMQTTCPCGAQIAGH
VKNGSMRIVGPKTCSNTWHGTFPINAYTTGPCTPLPAPNYKFALWRVSAEEYV
EVRQVGDFHYVTGMTTDNVKCPCQVPAPEFFTEVDGVRLHRYAPPCKPLLRD
EVTFQVGLNQYVVGSQLPCEPEPDVTVLTSMLTDPSHITAETAKRRLARGSPPS
LASSSASQLSAPSLKATCTTRHDSPDADLIEANLLWRQAMGGNITRVESENKVV
VLDSFDPLRAEEDEREVSVPAEILRRSRKFPPAMPIWARPDYNPPLLESWKDP
DYVPPVVHGCPLPPAKAPPIPPPRRKRTVVLTESSVSSALAELATKTFGSSESS
AVDSGTATGPPDQASDDGDKGSDVESYSSMPPLEGEPGDPDFSDGSWSTVS
SGADTEDVVCCSMSYTWTGALITPCAAEESKLPINPLSNSLLRHHSMVYSTTSR
SASLRQKKVTFDRLQVLDDHYRDVLKEMKAKASTVKAKLLSIEEACKLTPPHSA
KSKFGYGAKDVRSLSSRAVNHIRSVWEDLLEDTETPIDTTVMAKNEVFCIQPEK
GGRKPARLIVYPDLGVRVCEKMALYDVVSTLPQAVMGPSYGFQYSPGQRVEFL
```

-continued

VNAWKSKKNPMGFAYDTRCFDSTVTENDIRVEESIYQCCDLAPEARQAIKSLTE

RLYIGGPLTNSKGQNCGYRRCRASGVLTTSCGNTLTCYIKAQAACRAAGLRDC

TMLVCGDDLVVICESQGVQEDAANLRAFTEAMTRYSAPPGDPPQPEYDLELITS

CSSNVSVAHDGAGKRVYYLTRDPTTPLARAAWETARHTPINSWLGNIIMFAPTL

WARMILMTHFFSVLIARDQLEQALDCEIYGACYSIEPLDLPPIIQRLHGLSAFSLH

SYSPGEINRVATCLRKLGVPPLRAWRHRARNVRARLLSRGGRAAICGKYLFNW

AVKTKLKLTPIAAAGQLDLSGWFTAGYSGGDIYHSVSRARPRWFWFCLLLLAA

GVGIYLLPNR

Design14.mosaic3 Amino Acid Sequence
SEQ ID NO: 6
MSTNPKPQRKTKRNTNRRPQDVKFPGGGQIVGGVYLLPRRGPRLGVRATRKT

SERSQPRGRRQPIPKARQPEGRAWAQPGYPWPLYGNEGLGWAGWLLSPRG

SRPSWGPTDPRRRSRNLGKVIDTLTCGLADLMGYIPLVGAPLGGVARALAHGV

RVVEDGVNYATGNLPGCSFSIFLLALLSCLTTPASAYEVRNVSGVYHVTNDCSN

ASIVYEAADMIMHTPGCVPCVRENNSSRCWVALTPTLAARNASVPTTTIRRHVD

LLVGAAAFCSAMYVGDLCGSVFLISQLFTFSPRRHETVQDCNCSIYPGHVTGHR

MAWDMMMNWSPTAALVVSQLLRIPQAVVDMVAGAHWGVLAGLAYYSMAGN

WAKVLIVMLLFAGVDGGTYVTGGTMAKNTLGITSLFSPGSSQKIQLVNTNGSW

HINSTALNCNDSLNTGFLAALFYTHRFNSSGCPERLASCRPLTDFAQGWGPITY

AGSRSPDQRPYCWHYAPQPCGIVPAAQVCGPVYCFTPSPVWGTTDRFGVPT

YSWGENETDVLLLNNTRPPQGNWFGCTWMNGTGFTKTCGAPPCNIGGVGNN

TLTCPTDCFRKHPEATYTKCGSGPWLTPRCLVHYPYRLWHYPCTVNFTIFKVR

MYVGGVEHRLDAACNWTRGERCNLEDRDRSELSPLLLSTTEWQVLPCSFTTL

PALSTGLIHLHRNIVDVQYLYGIGSAVVSFAIKWEYVLLLFLLLADARVCACLWM

MLLIAQAEAALENLVVLNAASVAGAFIGILSFLVFFCAAVVYIKGKLVPGAAYALYG

VWPLLLLLLALPPRAYAMDREVAASCGGAVFIGLALLTLSPHYKVFLARLIWWLQ

YFITRAEAHLQVWIPPLNVRGGRDAIILLTCAIHPELIFTITKILLAILGPLMVLQAGL

TRVPYFVRAHGLIRACMLVRKVAGGHYVQMALMKLAALTGTYVYDHLTPLRDW

AHAGLRDLAVAVEPVVFSDMETKVITWGADTAACGDIILGLPVSARRGKEIFLGP

ADSLEGQGWRLLAPITAYSQQTRGLFGCIITSLTGRDRNQVEGEVQVVSTATQS

FLATCVNGVCWTVFHGAGSKTLAGPKGPIIQMYTNVDQDLVGWQAPPGARSL

TPCTCGSSDLYLVTRHADVIPVRRGDGRGSLLSPRPVSYLKGSSGGPLLCPS

GHAVGIFRAAVCTRGVAKAVDFVPVESMETTMRSPVFTDNSSPPAVPQTFQVA

HLHAPTGSGKSTRVPAAYAAQGYKVLVLNPSVAATLGFGAYMSKAYGTDPNIR

TGVRTITTGAPITYSTYGKFLADGGCSGGAYDIIICDECHSTDSTTILGIGTVLDQ

AETAGARLTVLATATPPGSVTVPHPNIEEVALSNIGEIPFYGKAIPIETIKGGRHLI

FCHSRKKCDELAAKLSGLGLNAVAYYRGLDVSVIPTSGDWWATDALMTGYT

GDFDSVIDCNTCVIQTVDFSLDPTFTIDTTTVPQDAVSRSQRRGRTGRGRGGIY

RFVTPGERPSGMFDSSILCECYDAGCAWYELTPAETTVRLRAYLNTPGLPVCQ

DHLEFWEGVFTGLTHIDAHFLSQTKQSGENLPYLVAYQATVCARAQAPPPSWD

QMWKCLTRLKPTLHGPTPLLYRLGAVQNEVTLTHPITKFIMACMSADLEWTST

WVLVGGVLAALAAYCLTTGSVVIVGRIILSGKPAVIPDREVLYQEFDEMEECASH

LPYIEQGMQLAEQFKQKALGLLQTASKQAEAAAPWESKWRALEAFWAKHMW

NFISGIQYLAGLSTLPGNPAIVSLMAFTASITSPLTTQHTLLFNILGGWVAAQLAA

PGAATAFVGAGLAGAAVGSVGLGKVLVDIIAGYGAGVAGALVAFKIMSGEVPST

EDLVNLLPAILSPGALVVGVVCAAVLRRHVGPGEGAVQWMNRLIAFASRGNHV

SPTHYVQESDAAARVTAILSSLTVTQLLRRLHQWISSECTTPCSGSWLRDIWD

WICEVLSDFKTWLKAKLMPQLPGIPFVSCQRGYRGVWRGDGIMHTRCHCGAEI

TGHVKNGTMRIVGPRTCRNMWSGTFPINAYTTGPSTPLPAPNYTFALWRVSAE

EYVEIRQVGDFHYVTGMTTDNLKCPCQVPSPEFFTELDGVRLHRFAPPCKPLL

REEVSFRVGLHEYPVGSQLPCEPEPDVAVLTSMLTDPSHITAEAAGRRLARGS

PPSMASSSASQLSAPSLKATCTANHDSPDAELIEANLLWRQEMGGNITRVESE

NKVVILDSFDPLVAEEDEREISVPAEILRKSRRFAPALPIWARPDYNPPLLETWK

KPDYEPPVVHGCPLPPPQSPPVPPPRKKRTVVLTESTVSTALAELATKSFGSSS

TSGITGDNTTTSSEPAPSGCPPDSDAESYSSMPPLEGEPGDPDLNDGSWSTV

SSEAGTEDWCCSMSYSWTGALVTPCAAEEQKLPINALSNSLLRHHNLVYSTT

SRSACQRQKKVTFDRLQVLDSHYQDVLKEVKAAASKVKANLLSVEEACSLTPP

HSARSKYGYGAKDVRCHARKAVNHINSVWKDLLEDSVTPIDTTIMAKNEVFCV

QPERGGRKPARLIVFPDLGVRVCEKMALYDVVSKLPLAVMGSSYGFQYSPGQ

RVEFLVQAWKSKKTPMGFSYDTRCFDSTVTESDIRTEEAIYQCCDLDPQARVAI

KSLTERLYVGGPLTNSRGENCGYRRCRASGVLTTSCGNTLTCYIKARAACRAA

GLQDCTMLVCGDDLVVICESAGVQEDAASLRAFTEAMTRYSAPPGDPPKPEYD

LELITSCSSNVSVAHDASGKRVYYLTRDPTTPLGRAAWETVRHTPVNSWLGNII

MYAPTLWARMVLMTHFFSILIAQEQLEKALDCQIYGACYSIEPLDLPQIIERLHGL

SAFTLHSYSPGEINRVAACLRKLGVPPLRAWRHRARSVRARLLSQGGRAATCG

KYLFNWAVRTKLKLTPIPAASRLDLSGWFTAGYSGGDIYHSVSHARPRWFMLC

LLLLSVGVGVYLLPNR

Design16.mosaic1 Amino Acid Sequence
                                              SEQ ID NO: 7
MSTNPKPQRKTKRNTNRRPQDVKFPGGGQIVGGVYLLPRRGPRLGVRAPRKT

SERSQPRGRRQPIPKARRPEGRTWAQPGFPWPLYGNEGCGWAGWLLSPRG

SRPSWGPSDPRRRSRNLGKVIDTLTCGFADLMGYIPLVGAPLGGAARVLAHGV

RVLEDGVNYATGNLPGCPFSIFLLALLSCLTIPASAYEVRNASGVYHVTNDCPN

SSIVYETADMIMHTPGCVPCVREGNSSRCWVALTPTLAARNSSIPTTTIRRHVD

LLVGTAAFCSAMYVGDLCGSVFLVSQLFTFSPRHHWTTQGCNCSIYPGHVSGH

RMAWDMMMNWSPTAALVVAQLLRIPQAILDMIAGAHWGVLAGMAYFSMVGN

WAKVLIVMLLFAGVDGHTHVTGGRVASSTQSLVSWLSQGPSQKIQLVNTNGS

WHINRTALNCNDSLQTGFIAALFYAHRFNASGCPERMASCRPIDKFAQGWGPIT

HVVPNISDQRPYCWHYAPQPCGIVPASEVCGPVYCFTPSPVVVGTTDRFGVPT

YSWGENETDVLLLNNTRPPQGNWFGCTWMNSTGFTKTCGGPPCNIGGVGNN

-continued

TLICPTDCFRKHPEATYTKCGSGPWLTPRCLVDYPYRLWHYPCTVNFTVFKVR

MYVGGVEHRLNAACNWTRGERCDLEDRDRSELSPLLLSTTEWQILPCSFTTLP

ALSTGLIHLHQNIVDIQYLYGIGSAAVSFAIKWEYVLLLFLLLADARVCACLWMML

LIAQAEAALENLVVLNAASLAGAHGVFSFLVFFCAAWYIKGRLVPGAAYALYGV

WPLLLLLLALPPRAYAMDREMAASCGGAVFIGLALLTLSPHYKVFLARLIWWLQ

YFITRAEAHLQVWVPPLNVRGGRDAIILLACAVHPELIFDITKLLLAILGPLMVLQA

GITRVPYFVRAQGLIRACMLVRKVAGGHYVQMAFMKLAALTGTYVYDHLTPLR

DWAHAGLRDLAVAVEPVIFSDMETKIITWGADTAACGDIISGLPVSARRGKEILL

GPADSFGEQGWRLLAPITAYAQQTRGLLGCIVTSLTGRDKNQVDGEVQVLSTA

TQSFLATCVNGVCWTVFHGAGSKTLAGPKGPITQMYTNVDQDLVGWPAPPGA

RSMTPCTCGSSDLYLVTRHADWPVRRGDSRGSLLSPRPVSYLKGSSGGPLL

CPSGHVVGIFRAAVCTRGVAKAVDFIPVESMETTMRSPIFTDNSSPPAVPQTFQ

VAHLHAPTGSGKSTKVPAAYAAQGYKVLVLNPSVAATLSFGAYMSKAHGTDPN

IRTGVRTITTGAPITYSTYGKFLADGGCSGGAYDIIMCDECHSTDSTTILGIGTVL

DQAETAGARLVVLATATPPGSITVPHPNIEEVALSNTGEIPFYGKAIPLEAIKGGR

HLIFCHSRKKCDELAAKLVALGVNAVAYYRGLDVSVIPTSGDVVVVATDALMTG

YTGDFDSVIDCNTCVTQTVDFSLDPTFTIDTTTVPQDAVSRSQRRGRTGRGRM

GIYRFVTPGERPSGMFDSSVLCECYDAGCAWYELTPAETTVRLRAYLNTPGLP

VCQDHLEFWEGVFTGLTRIDAHFLSQTKQSGENFPYLVAYQATVCARAQALPP

SWDQMWKCLTRLKPTLHGPTPLLYRLGAVQNEITLTHPITKYIMTCMAADLEW

TSTWVLVGGVLAALAAYCLTTGSVVIVGRIILSGRPAVVPDREVLYQQFDEMEE

CASHLPYIEQGMQLAEQFKQKALGLLQTATKQAEAAAPMVESKWRALETFWAK

HMWNFISGIQYLAGLSTLPGNPAIASLMAFTASITSPLTTQSTLLFNILGGWVAA

QLAAPGAATAFVGAGLAGAAVGSVGLGKVLIDILAGYGAGVAGALVAFKIMSGE

VPSTEDLVNLLPAILSPGALVVGWCAAILRRHVGPGEGAVQWMNRLIAFASRG

NHVSPTHYVQESDAAARVTAILSSLTVTQLLRRLHQWISSDCTTPCSDSWLRDI

WDWICEVLSDFKTWLKAKLMPQLPGIPFVSCQRGYRGAWRGDGIMHTRCHCG

AEITGHVKNGTMRIVGPRTCRNMWSGTFPINAYTTGPCTPLPAPNYTFALWRV

SAEEYVEIRRVGDFHYVTGMTTDNLKCPCQVPSPEFFTELDGVRLHRYAPPCK

PLLREEVSFRVGLHEYPVGSQLPCEPEPDVAVLTSMLTDPSHITAEAAKRRLAR

GSPPSEASSSASQLSAPSLKATCTANHDSPDAELIEANLLWRQEMGGDITRVE

SKNKWILDSFDPLVAEEDEREISVPAEILRKSRRFAQALPVWARPDYNPPLVET

WKKPDYEPPWHGCPLPPAKAPPIPPPRRKRTWLTESTVSTALAELATKSFGS

SSTSGITGDNTTTSSEPASSGCPPDSDAESYSSMPPLEGEPGDPDLNDGSWS

TVSSEAGTEDVVCCSMSYSWTGALITPCAAEETKLPINALSNSLLRHHNLVYST

TSRSACLRQKKVTFDRLQVLDNHYQDVLKEVKAAASKVKANLLSVEEACSLTPP

HSARSKFGYGAKDVRCHARKAVNHINSVWKDLLEDSVTPIDTTIMAKNEVFCVQ

PEKGGRKPARLIVYPDLGVRVCEKMALYDVVSKLPLAVMGSSYGFQYSPGQRV

EFLVKAWKSKKNPMGFAYDTRCFDSTVTENDIRTEESIYQCCDLAPEARQVIRS

LTERLYIGGPLTNSKGQNCGYRRCRASGVLTTNCGNTLTCYIKAQAACRAAGL

-continued

```
RDCTMLVCGDDLVVICESQGVQEDAANLRAFTEAMTRYSAPPGDLPQPEYDLE

LITSCSSNVSVAHDGAGKRVYYLTRDPATPFARAAWETAKHTPVNSWLGNIIMF

APTLWVRMILLTHFFSVLIARDQLEQALNCEIYGACYSIEPLDLPPIIQRLHGLSAF

SLHSYSPGEINRVASCLRKLGVPPLRVWRHRARSVRARLLSQGGRAATCGKYL

FNWAVKTKLKLTPIPAASRLDLSGWFVAGYSGGDIYHSVSRARPRWFMLCLLLL

SVGVGVYLLPNR

Design16.mosaic2 Amino Acid Sequence
                                                SEQ ID NO: 8
MSTNPKPQRQTKRNTNRRPQDVKFPGGGQIVGGVYLLPRRGPRLGVRATRKT

SERPQPRGRRQPIPKARQPEGRAWAQPGHPWPLYGNEGMGWAGWLLSPRG

SRPSWGPNDPRRRSRNLGKVIDTLTCGLADLMGYIPLVGAPLGGVARALAHGV

RVVEDGVNYATGNLPGCSFSIFLLALLSCLTIPASAYQVRNSTGLYHVTNDCSN

SSIVYEAADVIMHTPGCVPCVREDNSSRCWVALTPTLAARNASIPTTAIRRHVDL

LVGAAAFCSAMYVGDLCGSVFLISQLFTFSPRRYETVQDCNCSLYPGHVSGHR

MAWDMIMNWSPTTALVVSQLLRIPQAVVDMVAGAHWGVLAGLAYYSMVGNW

AKVLWMLLFAGVDGGTHVTGGKVAYTTQGFTSFFSRGPSQKIQLVNTNGSWH

INRTALNCNDSLNTGFLAALFYAHKFNSSGCSGRMASCRPIDEFAQGWGPITYA

EPHDLDQRPYCWHYAPRPCGIVPASTVCGPVYCFTPSPVVVGTTDKSGAPTY

NWGENDTDVFVLNNTRPPRGNWFGCTWMNSTGFTKVCGAPPCVIGGVGNNT

LRCPTDCFRKHPEATYARCGSGPWLTPRCLVHYPYRLWHYPCTINYTIFKVRM

YVGGVEHRLEAACNWTRGERCDLTDRDRSELSPLLLSTTEWQVLPCSFTTLPA

LSTGLIHLHRNIVDVQYLYGIGSAVVSFAIKWEYILLLFLLLADARFCACLWMMLL

VAQAEAALENLVVLNAASVAGAHGILSFLVFFCAAVVYIKGKLVPGAAYAFYGVW

PLLLLLMALPARAYAMDREMAASCGGAVFVGLVLLTLSPYYKVFLAKLIWWLQY

LITRAEAHLQVWIPPLNVRGGRDAVILLTCAIHPELIFTITKILLAILGPLMVLQAGIT

KVPYFVRAHGLIRACMLVRKVAGGHYVQMALMKLAALTGTYVYDHLTPLQDWA

HAGLRDLAVAVEPVVFSRMETKLITWGADTAACGDILSGLPVSARRGKEIFLGP

ADSLEGQGWRLLAPITAYSQQTRGLLGCIITSLTGRDKNQVEGEVQIVSTATQT

FLATCVNGVCWTVYHGAGTRTIASSKGPVIQMYTNVDQDLVGWPAPQGSRSL

TPCTCGSSDLYLVTRHADVIPVRRRGDNRGSLLSPRPISYLKGSSGGPLLCPSG

HAAGIFRAAVCTRGVAKAVDFVPVESMETTMRSPVFTDNSTPPAVPQSFQVTH

LHAPTGSGKSTRVPAAYAAQGYKVLVLNPSVAATLGFGVYMSKAHGVDPNVRT

GVRTITTGSPITYSTYGKFLADGGCSGGAYDIIMCDECHSTDSTSILGIGTVLDQ

AETAGVRLTVLATATPPGSVTVPHPNIEEVALSNIGEIPFYGKAIPIEAIKGGRHLI

FCHSKKKCDELAAKLSALGLNAVAYYRGLDVSVIPSSGDVVVVATDALMTGFTG

DFDSVIDCNTCVIQTVDFSLDPTFTIETTTVPQDAVSRTQRRGRTGRGRGGIYR

FVTPGERPSGMFDSSVLCECYDAGCAWYELTPAVTSVRLRAYLNTPGLPVCQ

VHLEFWESVFTGLTHIDAHFLSQTKQAGENFPYLTAYQATVCARAQAPPPSWD

QMWKCLNRLKPTLHGPTPLLYRLGAVQNEVTLTHPITKFIMACMSADLEWTST

WVLVGGVLAALAAYCLSTGCVVIVGRIILSGKPAVIPDREVLYREFDEMEECASQ
```

-continued

```
LPYIEQGMQLAEQFKQKAIGLLQTATKQAEAAAPWESKWRALEAFWAKHMW

NFISGIQYLAGLSTLPGNPAIVSLMAFTASITSPLTTQHTLLFNILGGWVAAQLAP

PRAASAFVGAGIAGAAVGSIGLGKVLVDILAGYGAGVAGALVAFKVMSGDMPST

EDLVNLLPAILSPGALVVGWCAAILRRHVGPGEGAVQWMNRLIAFASRGNHVS

PTHYVPESDAAARVTQILSNLTITQLLKRLHQWINEDCSTPCSGSWLRDVWDWI

CTVLADFKTWLQSKVLPRLPGVPFFSCQRGYKGVWRGDGIMYTTCPCGAQIT

GHVKNGTMRIVGPKTCRNMWSGTFPINAYTTGPCTPLPAPNYKFALWRVSAEE

YVEIRQVGDFHYVTGMTADNLKCPCQVPAPEFFTELDGVRLHRFAPPCKPLLR

DEVSFRVGLHDYPVGSQLPCEPEPDVAVVTSMLTDPSHITAEAAGRRLARGSP

PSVASSSASQLSAPSLKATCTTNHDSPDAELIEANLLWRQEMGGNITRVESENK

WVLDSFDPLVAEEDEREVSIPAEILRKSRKFPRAMPIWARPDYNPPLIESWKDP

DYVPPVVHGCPLPPPRSPPVPPPRKKRTWLTESTLSTALAELATKSFGSSSTS

GITGDDTTTSSEPAPSGCPPDSDAESCSSMPPLEGEPGDPDFSDGWSTVSS

GADTEDVVCCSMSYSWTGALVTPCAAEEQKLPINALSNSLLRHHNMVYSTTSR

SACQRQKKVTFDRLQVLDSHYQDVLKEVKAAASTVKANLLSVEEACSLTPPHS

AKSKFGYGAKDVRNLSSKAVNHIHSVWKDLLEDSETPIDTTIMAKNEIFCVQPEK

GGRKSARLIVFPDLGVRVCEKMALYDVVSKLPVAVMGSSYGFQYSPGQRVEFL

VQAWKSKKTPMGFSYDTRCFDSTVTESDIRTEEAIYQCCDLDPQARVAIKSLTE

RLYVGGPLTNSRGENCGYRRCRASGVLTTSCGNTLTCYIKARAACRAAGLQDC

TMLVCGDDLVVICESAGVQEDAASLRAFTEAMTRYSAPPGDPPQPEYDLELITS

CSSNVSVAHDGTGKRVYYLTRDPTIPLARAAWETARHTPINSWLGNIIMFAPTL

WARMILMTHFFSVLIARDQLEQALDCEIYGACYSIEPLDLPLIQRLHGLSAFSLH

SYSPGEINRVAACLRKLGVPPLRAWRHRARNVRARLLSRGGRAAICGKYLFNW

AVRTKLKLTPIAAASQLDLSGWFVAGYGGGDIYHSLSRARPRWFWFCLLLLAA

GVGIYLLPNR

Design16.mosaic3 Amino Acid Sequence
                                                   SEQ ID NO: 10
MSTNPKPQRKIKRNTNRRPQDVKFPGGGKIVGGVYLLPRRGPRLGVRTTRKTS

ERSQPRGRRQPIPKARQPEGRTWAQPGYPWPLYGNEGCGWAGWLLSPRGS

RPNWGPTDPRRRSRNLGKVIDTLTCGLADLMGYIPLVGGPLGGAARALAHGVR

VLEDGVNYATGNLPGCSFSIFLLALLSCLTVPASAYQVRNSSGLYHVTNDCPNS

SIVYEAADAILHTPGCVPCVREGNASRCWVAMTPTVATRDGKLPTTQLRRHIDL

LVGSATLCSALYVGDLCGSVFLVGQLFTFSPRRHWTTQDCNCSIYPGHITGHR

MAWDMMMNWSPTTALVVAQLLRVPQAILDMIAGAHWGVLAGIAYFSMVGNWA

KVLVVLLLFAGVDAETHVTGGSAAKDTSGFTSLFRIGARQNIQLINTNGSWHINR

TALNCNASLDTGWVAGLFYYHKFNSSGCPERLASCRPLADFDQGWGPISYAN

GSGPDQRPYCWHYPPKPCGIVPAKSVCGPVYCFTPSPVVVGTTDRSGAPTYN

WGENETDVLVLNNTRPPLGNWFGCTWMNSSGFTKVCGAPPCVIGGVGNNTL

HCPTDCFRKHPEATYSRCGSGPWITPRCLVNYPYRLWHYPCTVNYTLFKVRM

YVGGVEHRLDAACNWTRGERCDLDDRDRSELSPLLLSTTQWQVLPCSFTSLP
```

-continued

ALSTGLIHLHQNIVDVQYLYGVGSSIASWAIKWEYVVLLFLLLADARVCSCLWM

MLLISQAEAALENLVILNAASLAGTHGLVSFLVFFCFAWYLKGRWVPGAVYALY

GMWPLLLLLLALPQRAYALDTEVAASCGGWLVGLMALTLSPYYKHYISWCLW

WLQYFLTRVEAHLHVWVPPLDVRGGRDAVILLMCVVHPTLVFDITKLLLAVFGP

LWILQASLLKVPYFVRVQGLLRICALARKMAGGHYVQMAIIKLGALTGTYIYNHLT

PLRDWAHNGLRDLAVAVEPVVFSQMETKLITWGADTAACGDIINGLPVSARRG

QEILLGPADGMVSKGWRLLAPITAYSQQTRGLLGCIVTSLTGRDKNQAEGEVQI

VSTAAQTFLATCINGVCWTVYHGAGTRTIASPKGPVIQMYTNVDKDLVGWPAP

QGARSLTPCTCGSSDLYLVTRHADVIPVRRRGDSRGGLLSPRPISYLKGSSGG

PLLCPAGHAVGIFRAAVCTRGVAKAVDFIPVENLETTMRSPVFTDNSSPPVVPQ

SFQVAHLHAPTGSGKSTRVPAAYAAQGYKVLVLNPSVAATLGFGAYMSKAHGI

DPNIRTGVRTITTGGPITYSTYCKFLADGGCSGGAYDIIICDECHSTDATSILGIGT

ALDQAETAGARLVVLATATPPGSVTVSHPNIEEVALSTTGEIPFYGKAIPLEVIKG

GRHLIFCHSKKKCDELAAKLVALGINAVAYYRGLDVSVIPTSGNVVVVATDALMT

GFTGDFDSVIDCNTCVTQTVDFSLDPTFTIETTTLPQDAVSRTQRRGRTGRGKP

GIYRFVAPGERPSGMFDSSILCECYDAGCAVVYELTPAETTVRLRAYMNTPGLP

VCQDHLEFWEGVFTGLTHIDAHFLSQTKQSGENLPYLVAYQATVCARAQAPPP

SWDQMWKCLIRLKPTLHGSTPLLYRLGAVQNEVTLTHPVTKYIMTCMSADLEV

VTSTWVLVGGVLAALAAYCLSTGCVVIVGRIVLSGKPAIIPDREVLYQEFDEMEE

CSQQLPYIEQGMMLAEQFKQKAFGLLQTASRQAEVIAPAVQTNWQKLEAFWA

KHMWNFVSGIQYLAGLSTLPGNPAIASLMAFTAAVTSPLTTSQTLLFNILGGWLA

AQLAAPGAATTFVGAGLAGAAIGSVGLGKVLVDILAGYGAGVAGALVAFKIMSG

EAPSTEDLINLLPAILSPGALWGWCAAVLRRHVGPGEGAVQWMNRLIAFASR

GNHVSPTHYVPESDAAARVTTILSSLTVTQLLRRLHQWISSECTTPCSGSWLKD

VWDWICTVLSDFKTWLQSKLLPRLPGLPFLSCQRGYKGVWRGDGIMQTTCPC

GAQIAGHVKNGSMRIVGPRTCSNTWHGTFPINAYTTGPCTPSPAPNYSRALWR

VAAEEYVEVTRVGDFHYVTGMTTDNVKCPCQVPAPEFFTEVDGVRLHRYAPA

CKPLLREEVTFQVGLNQYLVGSQLPCEPEPDVTWTSMLTDPSHITAETAKRRL

ARGSPPSLASSSASQLSAPSLKATCTTRHDSPDADLVEANLLWRQEMGGNITR

VESENKWILDSFEPLRAEEDEREVSVPAEILRKTRKFPPALPIWARPDYNPPLL

ESWKDPDYVPPWHGCPLPPTKAPPIPPPRRKRTWLSESTVSSALAELATKTF

GSSESSAVDSGTATAPPDQASDDGDKGSDVESYSSMPPLEGEPGDPDLSDGS

WSTVSEEAGEDWCCSMSYTWTGALITPCAAEESKLPINPLSNSLLRHHSMVY

STTSRSASLRQKKVTFDRLQVLDDHYRDVLKEMKAKASTVKAKLLSIEEACKLT

PPHSAKSKYGYGAKDVRNLSSRAVNHIRSVWEDLLEDTETPIDTTIMAKSEVFC

VQPEKGGRKPARLIVFPDLGVRVCEKMALYDWSTLPQAVMGSSYGFQYSPK

QRVEFLVNTWKSKKCPMGFSYDTRCFDSTVTESDIRVEESIYQCCDLAPEARQ

AIKSLTERLYIGGPLTNSKGQNCGYRRCRASGVLTTSCGNTLTCYLKATAACRA

AKLRDCTMLVNGDDLWICESAGTQEDAANLRVFTEAMTRYSAPPGDPPRPEY

DLELITSCSSNVSVAHDASGKRVYYLTRDPTTPIARAAWETARSTPVNSWLGNII

MYAPTLWARMVLMTHFFSILIAQEQLEKALDCQIYGACYSIEPLDLPQIIERLHGL

```
SAFSLHSYSPGEINRVAACLRKLGVPPLRAWRHRARSVRAKLLSRGGRAAICG

RYLFNWAVKTKLKLTPIAAAGQLDLSGWFTAGYSGGDIYHSVSHARPRWFWFC

LLLLTAGVGIYLLPNR

Design16.mosaic4 Amino Acid Sequence
                                                      SEQ ID NO: 11
MSTNPKPQRRTKRNTNRRPQDVKFPGGGQIVGGVYLLPRRGPKLGVRATRKT

SERSQPRGRRQPIPKARRPEGRAWAQPGYPWPLYGNEGLGWAGWLLSPRG

SRPSWGPTDPRRRSRNLGRVIDTLTCGFADLMGYIPFVGAPLGGAARALAHGV

RVLEDSVNYATGNLPGCSFSIFLLALLSCLTTPASAYEVRNVSGVYHVTNDCSN

ASIVYEAADMIMHTPGCVPCVRENNSSRCWVALTPTLAARNASVPTTTIRRHVD

LLVGAAALCSAMYVGDLCGSVFLVAQLFTFSPRRHETVQDCNCSIYPGHVTGH

RMAWDMMMNWSPTAALVVSQLLRIPQAVMDMVAGAHWGILAGLAYYSMAGN

WAKVLLVLLLFAGVDGNTRVSGGEAAKNTMGFASLFVSGPSQKIQLINTNGSW

HINSTALNCNDSLQTGFLAALFYTHKFNSSGCPERMASCRSIDKFDQGWGPITY

AEPGSSDQRPYCWHYAPKPCGIVPASQVCGPVYCFTPSPWVGTTDRFGAPT

YTWGENETDVLILNNTRPPQGNWFGCTWMNGTGFTKTCGAPPCNIGGVGNNT

LTCPTDCFRKHPDATYTKCGSGPWLTPRCMVDYPYRLWHYPCTVNFTIFKVR

MYVGGVEHRLSAACNWTRGERCNLEDRDRSELSPLLLTTTQWQVLPCSFTTL

PALTTGLIHLHQNVVDVQYLYGVGSSIVSWAIKWEYVILLFLLLADARICSCLWM

MLLISQVEAALENLVLLNAASLAGTHGLASFLVFFCFAWYLKGKWVPGAVYAFY

GMWPLLLLLLALPQRAYALDTEMAASCGGAVFVGLALLTLSPYYKRYISWCLW

WLQYFLTRVEAQLHVWVPPLNVRGGRDAIILLTCAVHPELIFEITKILLAIIGPLMV

LQAGLTRVPYFVRAQGLIRVCMLVRKAAGGHYVQMAIIKLGALTGTYVYNHLTP

LRDWAHTGLRDLAVAVEPVVFSDMETKVITWGADTAACGDIILGLPVSARRGRE

ILLGPADSLEGRGWRLLAPITAYAQQTRGLFGCIITSLTGRDRNQVEGEVQVVS

TATQSFLATCINGVCWTVYHGAGSKTLAGPKGPVTQMYTNVDQDLVGWQAPP

GARSLTPCTCGSSDLYLVTRHADVIPVRRRGDGRGSLLSPRPVSYLKGSSGGP

LLCPSGHAVGIFRAAVCTRGVAKAVDFIPVESLETTMRSPVFTDNSSPPAVPQS

FQVAYLHAPTGSGKSTKVPAAYAAQGYTVLVLNPSVAATLGFGAYMSKAHGVD

PNIRTGVRTITTGASITYSTYGKFLADGGCSGGAYDVIICDECHSTDATTILGVGT

VLDQAETAGARLVVLATATPPGSVTVPHSNIEEVALSNTGEVPFYGKAIPIETIKG

GRHLIFCHSKKKCDELAAKLSGLGLNAVAYYRGLDVSVIPASGDVVVVATDALM

TGYTGDFDSVIDCNTCVTQSVDFSLDPTFTIETITLPQDAVSRSQRRGRTGRGR

RGIYRFVTPGERPSGMFDSVVLCECYDAGCAWYELTPAETSVRLRAYLNTPGL

PVCQDHLEFWESVFTGLTHIDAHFLSQTKQAGDNFPYLVAYQATVCARAKAPP

PSWDQMWKCLVRLKPTLHGPTPLLYRLGAVQNEVILTHPITKYIMACMSADLEV

VTSTWVLVGGVLAALAAYCLTTGCVVIVGRVVLSGKPAIIPDREILYREFDEMEE

CSQHLPYIEQGMALAEQFKQKALGLLQTASRQAEVITPAVQTNWQKLEVFWAK

HMWNFISGVQYLAGLSTLPGNPAIASLMAFTASVTSPLTTQNTLLFNILGGWVA

AQLAPPSAASAFVGAGIAGAAIGSIGLGKVLVDVLAGYGAGVAGALVAFKVMSG
```

-continued

EMPSTEDLVNLLPAILSPGALVVGVVCAAILRRHVGPGEGAVQWMNRLIAFASR

GNHVSPTHYVPESDAAARVTQILSSLTITQLLKRLHQWISEDCSTPCSGSWLRDI

WDWICTVLTDFKTWLQSKLLPRLPGVPFLSCQRGYRGVWRGDGIMHTTCPCG

AQITGHVKNGSMRIVGPKTCSNTWHGTFPINAHTTGPCTPSPAPNYSKALWRV

AAEEYVEVRRVGDFHYVTGMTTDNIKCPCQVPAPEFFTELDGVRLHRYAPACK

PLLRDEVTFQVGLNQYWGSQLPCEPEPDVTVLTSMLTDPPHITAEAARRRLAR

GSPPSMASSSASQLSAPSLKATCTTHHDSPDADLIEANLLWRQEMGGNITRVE

SENKVVILDSFDPLRAEEDEREVSVAAEILRKSRRFAPALPIWARPDYNPPLLET

WKKPDYEPPWHGCPLPPPQSPPVPPPRKKRMVVLTESTVSSALAELATKTFG

SSGSSAVDSGTATAPPDQPSDDGDAGSDVESYSSMPPLEGEPGDPDLSDGS

WSTVSEEASEDVVCCSMSYTWTGAMITPCAAEESKLPINALSNPLLRHHNMVY

ATTSRSASQRQKKVTFDRLQVLDDHYQDVLKEMKAKASTVKAKLLSVEEACKL

TPPHSARSKFGYGAKDVRSLSSKAVNHIRSVWKDLLEDTETPIDTTVMAKNEVF

CIQPEKGGRKPARFIVFPDLGVRVCEKMALYDWSTLPQAVMGPSYGFQYSPG

QRVEFLVNAWKSKKCPMGFAYDTRCFDSTVTENDIRVEESIYQSCDLAPEARQ

AIRSLTERLYVGGPLTNSKGQSCGYRRCRASGVLTTSCGNTLTCYLKASAACR

AAKLQDCTMLVNGDDLVVICESAGTQEDAASLRVFTEAMTRYSAPPGDPPKPE

YDLELITSCSSNVSVAHDATGKRVYYLTRDPTTPLARAAWETARHTPVNSWLG

NIIMYAPTLWVRMILMTHFFSILLAQEQLEKALDCQIYGATYSIEPLDLPQIIQRLH

GLSAFSLHSYSPGEINRVATCLRKLGVPPLRVWRHRARSVRAKLLSQGGRAAT

CGRYLFNWAVRTKLKLTPIPAASQLDLSSWFVAGYSGGDIYHSLSRARPRWFM

WCLLLLSVGVGIYLLPNR

Design17.mosaic1 Amino Acid Sequence
                                    SEQ ID NO: 12
MSTNPKPQRKTKRNTNRRPQDVKFPGGGQIVGGVYLLPRRGPRLGVRATRKT

SERSQPRGRRQPIPKARRPEGRTWAQPGYPWPLYGNEGCGWAGWLLSPRG

SRPSWGPTDPRRRSRNLGKVIDTLTCGFADLMGYIPLVGAPLGGAARALAHGV

RVLEDGVNYATGNLPGCSFSIFLLALLSCLTVPASAYQVRNSTGLYHVTNDCPN

SSIVYEAADAILHTPGCVPCVREGNASRCWVAVTPTVATRDGKLPTTQLRRHID

LLVGSATLCSALYVGDLCGSVFLVGQLFTFSPRRHWTTQDCNCSIYPGHITGHR

MAWDMMMNWSPTTALVVAQLLRIPQAILDMIAGAHWGVLAGIAYFSMVGNWA

KVLVVLLLFAGVDAETHVTGGSAAKDTSGFTSLFRIGARQNIQLINTNGSWHINR

TALNCNASLDTGWVAGLFYYHKFNSSGCPERMASCRSLADFDQGWGPISYAN

GSGPEHRPYCWHYPPKPCGIVPAKSVCGPVYCFTPSPVVVGTTDRSGAPTYN

WGENDTDVFVLNNTRPPLGNWFGCTWMNSTGFTKVCGAPPCVIGGVGNNTL

HCPTDCFRKHPEATYSRCGSGPWITPRCLVNYPYRLWHYPCTINYTIFKVRMY

VGGVEHRLEAACNWTRGERCDLEDRDRSELSPLLLSTTQWQVLPCSFTTLPAL

STGLIHLHQNIVDVQYLYGVGSSIASWAIKWEYVVLLFLLLADARVCSCLWMMLL

ISQAEAALENLVILNAASLAGTHGLVSFLVFFCFAWYLKGRWVPGAVYALYGM

WPLLLLLLALPQRAYALDTEVAASCGGVVLVGLMALTLSPYYKRYISWCLWWL

-continued

QYFLTRVEAQLHVWVPPLNVRGGRDAVILLMCVVHPTLVFDITKLLLAVFGPLWI

LQASLLKVPYFVRVQGLLRICALARKMAGGHYVQMAIIKLGALTGTYVYNHLTPL

RDWAHNGLRDLAVAVEPWFSQMETKLITWGADTAACGDIINGLPVSARRGREI

LLGPADGMVSKGWRLLAPITAYAQQTRGLLGCIITSLTGRDKNQVEGEVQIVST

AAQTFLATCINGVCWTVYHGAGTRTIASPKGPVIQMYTNVDQDLVGWPAPQGA

RSLTPCTCGSSDLYLVTRHADVIPVRRRGDSRGSLLSPRPISYLKGSSGGPLLC

PAGHAVGIFRAAVCTRGVAKAVDFIPVENLETTMRSPVFTDNSSPPAVPQSFQV

AHLHAPTGSGKSTKVPAAYAAQGYKVLVLNPSVAATLGFGAYMSKAHGIDPNIR

TGVRTITTGSPITYSTYGKFLADGGCSGGAYDIIICDECHSTDATSILGIGTVLDQ

AETAGARLVVLATATPPGSVTVPHPNIEEVALSTTGEIPFYGKAIPLEVIKGGRHL

IFCHSKKKCDELAAKLVALGINAVAYYRGLDVSVIPTSGDVVVVATDALMTGFTG

DFDSVIDCNTCVTQTVDFSLDPTFTIETTTLPQDAVSRTQRRGRTGRGKPGIYR

FVAPGERPSGMFDSSVLCECYDAGCAWYELTPAETTVRLRAYMNTPGLPVCQ

DHLEFWEGVFTGLTHIDAHFLSQTKQSGENFPYLVAYQATVCARAQAPPPSWD

QMWKCLIRLKPTLHGPTPLLYRLGAVQNEVTLTHPITKYIMTCMSADLEWTST

WVLVGGVLAALAAYCLSTGCVVIVGRIVLSGKPAIIPDREVLYREFDEMEECSQH

LPYIEQGMMLAEQFKQKALGLLQTASRQAEVIAPAVQTNWQKLEAFWAKHMW

NFISGIQYLAGLSTLPGNPAIASLMAFTAAVTSPLTTSQTLLFNILGGWVAAQLAA

PGAATAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRGNHVS

PTHYVPESDAAARVTAILSSLTVTQLLRRLHQWISSECTTPCSGSWLRDIWDWI

CEVLSDFKTWLKAKLMPQLPGIPFVSCQRGYRGVWRGDGIMHTRCHCGAEIT

GHVKNGTMRIVGPRTCRNMWSGTFPINAYTTGPCTPLPAPNYTFALWRVSAEE

YVEIRQVGDFHYVTGMTTDNLKCPCQVPSPEFFTELDGVRLHRFAPPCKPLLR

EEVSFRVGLHEYPVGSQLPCEPEPDVAVLTSMLTDPSHITAEAAGRRLARGSP

PSVASSSASQLSAPSLKATCTANHDSPDAELIEANLLWRQEMGGNITRVESENK

WILDSFDPLVAEEDEREISVPAEILRKSRRFAPALPIWARPDYNPPLLETWKKP

DYEPPVVHGCPLPPPQSPPVPPPRKKRTVVLTESTVSTALAELATKSFGSSSTS

GITGDNTTTSSEPAPSGCPPDSDAESYSSMPPLEGEPGDPDLSDGSWSTVSS

GADTEDVVCCSMSYSWTGALVTPCAAEEQKLPINALSNSLLRHHNLVYSTTSR

SACQRQKKVTFDRLQVLDSHYQDVLKEVKAAASKVKANLLSVEEACSLTPPHS

AKSKFGYGAKDVRCHARKAVNHINSVWKDLLEDSVTPIDTTIMAKNEVFCVQPE

KGGRKPARLIVFPDLGVRVCEKMALYDWSKLPLAVMGSSYGFQYSPGQRVEF

LVQAWKSKKTPMGFSYDTRCFDSTVTESDIRTEEAIYQCCDLDPQARVAIKSLT

ERLYVGGPLTNSRGENCGYRRCRASGVLTTSCGNTLTCYIKARAACRAAGLQD

CTMLVCGDDLVVICESAGVQEDAASLRAFTEAMTRYSAPPGDPPQPEYDLELIT

SCSSNVSVAHDGAGKRVYYLTRDPTTPLARAAWETARHTPVNSWLGNIIMFAP

TLWARMILMTHFFSVLIARDQLEQALDCEIYGACYSIEPLDLPPIIQRLHGLSAFS

-continued

LHSYSPGEINRVAACLRKLGVPPLRAWRHRARSVRARLLSRGGRAAICGKYLF

NWAVRTKLKLTPIAAAGQLDLSGWFTAGYSGGDIYHSVSHARPRWFWFCLLLL

AAGVGIYLLPNR

Design18.mosaic1 Amino Acid Sequence
SEQ ID NO 13
MSTIPKPQRKTKRNTNRRPQDVKFPGGGQIVGGVYLLPRRGPRLGVRTTRKTS

ERSQPRGRRQPIPKARRPEGRTWAQPGYPWPLYGNESCGWAGWLLSPRGS

RPSWGPSDPRRRSRNLGKVIDTLTCGLADLMGYIPLVGAPLGGAARALAHGVR

VLEDGVNYATGNLPGCSFSIFLLALLSCLTVPASAYQVRNSTGLYHVTNDCPNS

SIVYETADTILHSPGCVPCVREGNASRCWVAMTPTVATRDGRLPTTQLRRHIDL

LVGGATLCSALYVGDLCGSIFLVGQLFTFSPRRHWTTQGCNCSIYPGHITGHRM

AWDMMMNWSPTTALWAQLLRVPQAILDMIAGAHWGVLAGMAYFSMVGNWA

KVLVVLLLFAGVDAGTHVTGGSAAKDTSGFTSLFRIGARQNIQLINTNGSWHINS

TALNCNDSLNTGWIAGLFYHHKFNSSGCPERLASCRPLTDFDQGWGPISHANG

SGPDQRPYCWHYPPRPCGIVPAKSVCGPVYCFTPSPWVGTTDRSGAPTYNW

GENDTDVFVLNNTRPPLGNWFGCTWMNSTGFTKVCGAPPCAIGGVGNNTLRC

PTDCFRKHPEATYSRCGSGPWITPRCLVNYPYRLWHYPCTINYTIFKVRMYVG

GVEHRLEAACNWTRGERCDLEDRDRSELSPLLLSTTQWQILPCSFTTLPALST

GLIHLHQNIVDVQYLYGVGSSIASWAIKWEYVVLLFLLLADARVCSCLWMMLLIS

QVEAALENLVILNAASLAGTHGLVSFLVFFCFAWYLKGRWVPGAVYALYGMWP

LLLLLLALPQRAYALDTEVAASCGGVVLAGLMALTLSPHYKRYISWCMWWLQY

FLTRAEAQLHVWVPPLNVRGGRDAVILLMCWHPTLVFDITKLLLAIFGPLWILQ

ASLLKVPYFVRVQGLLRICALARKMVGGHYVQMAIIKLGALTGTYIYNHLTPLRD

WAHNGLRDLAVAVEPVVFSRMETKLITWGADTAACGDIINGLPVSARRGQEILL

GPADGMVSKGWRLLAPITAYAQQTRGLLGCIITSLTGRDKNQAEGEVQIVSTAT

QTFLATCINGVCWTVYHGAGTRTIASPKGPVIQMYTNVDQDLVGWPAPQGSRS

LTPCTCGSSDLYLVTRHADVIPVRRRGDGRGSLLSPRPISYLKGSSGGPLLCPA

GHAVGLFRAAVCTRGVAKAVDFIPVENLETTMRSPVFTDNSSPPWPQSFQVA

HLHAPTGSGKSTKVPAAYAAQGYTVLVLNPSVAATLSFGAYMSKAHGVDPNIR

TGVRTITTGSPITYSTYGKFLADGGCSGGAYDIIICDECHSTDATSILGIGTVLDQ

AETAGARLWLATATPPGSITVPHPNIEEVALSTTGEIPFYGKAIPLEVIKGGRHLI

FCHSKKKCDELAAKLVALGINAVAYYRGLDVSVIPTSGNVWVATDALMTGFTG

DFDSVIDCNTCVTQTVDFSLDPTFTIETITLPQDAVSRTQRRGRTGRGKPGIYRF

VTPGERPSGMFDSSVLCECYDAGCAWYELTPAETTVRLRAYMNTPGLPVCQD

HLEFWEGVFTGLTHIDAHFLSQTKQSGENFPYLVAYQATVCARAQAPPPSWDQ

MWKCLIRLKPTLHGSTPLLYRLGAVQNEVTLTHPITKYIMTCMSADLEIVTSTWV

LVGGVLAALAAYCLSTGCVVIVGRIVLSGKPAVIPDREVLYQEFDEMEECSQHL

PYIEQGMVLAEQFKQKALGLLQTASRQAEVITPAVQTNWQRLETFWAKHMWN

FISGIQYLAGLSTLPGNPAIASLMAFTAAVTSPLTTGQTLLFNILGGWLAAQLAAP

GAATAFVGAGLAGAAIGSVGLGKVLVDILAGYGAGVAGALVAFKIMSGDVPSTE

-continued

DLVNLLPAILSPGALWGWCAAILRRHVGPGEGAVQWMNRLIAFASRGNHVSP

THYVQESDAAARVTAILSSLTVTQLLRRLHQWISSECTTPCSGSWLRDIWDWIC

EVLSDFKTWLKAKLMPQLPGIPFVSCQRGYRGVWRGDGIMHTRCHCGAEIAG

HVKNGTMRIVGPRTCRNMWSGTFPINAYTTGPCTPLPAPNYKFALWRVSAEEY

VEIRRVGDFHYVTGMTADNLKCPCQVPSPEFFTELDGVRLHRFAPPCKPLLRD

EVSFRVGLHEYPVGSQLPCEPEPDVSVLTSMLTDPSHITAEAAGRRLARGSPP

SMASSSASQLSAPSLKATCTANHDSPDAELIEASLLWRQEMGSNITRVESENKV

VILDSFDPLVAEEDEREVSVPAEILRKSRRFAQALPVWARPDYNPPLIETWKKP

DYEPPVVHGCPLPPPRSPPVPPPRKKRTVVLTESTLSTALAELAAKSFGSSSTS

GITGDDTTTSSEPAPSGCPPDSDAESCSSMPPLEGEPGDPDLSDGSWSTVSS

GADTEDVVCCSMSYTWTGALVTPCAAEEQKLPINALSNSLLRHHNMVYSTTSR

SACQRQKKVTFDRLQVLDSHYQDVLKEVKAAASKVKANLLSVEEACSLTPPHS

AKSKFGYGAKDVRCHARKAVAHINSVWKDLLEDSVTPIDTTIMAKNEVFCVQPE

KGGRKPARLIVFPDLGVRVCEKMALYDWSKLPVAVMGSSYGFQYSPGQRVEF

LVQAWKSKKTPMGFSYDTRCFDSTVTENDIRTEEAIYQCCDLDPQARVAIKSLT

ERLYVGGPLTNSRGENCGYRRCRASGVLTTSCGNTLTCYIKARAACRAAGLQD

CTMLVCGDDLVVICESAGVQEDAASLRAFTEAMTRYSAPPGDPPQPEYDLELIT

SCSSNVSVAHDGAGKRVYYLTRDPTTPLARAAWETARHTPVNSWLGNIIMFAP

TLWARMILMTHFFSVLIARDQLEQALNCEIYGACYSIEPLDLPLIIQRLHGLSAFSL

HSYSPGEINRVAACLRKLGVPPLRAWRHRARSVRAKLLSRGGRAAICGKYLFN

WAVRTKLKLTPIAAAGRLDLSGWFTAGYSGGDIYHSVSHARPRWFWFCLLLLA

AGVGIYLLPNR

Design18.mosaic2 Amino Acid Sequence
SEQ ID NO: 14
MSTNPKPQRKTKRNTNRRPQDVKFPGGGQIVGGVYLLPRRGPRLGVRATRKT

SERSQPRGRRQPIPKARRPEGRSWAQPGYPWPLYGNEGCGWAGWLLSPRG

SRPSWGPTDPRRRSRNLGRVIDTLTCGFADLMGYIPLVGAPLGGVARALAHGV

RVLEDSVNYATGNLPGCSFSIFLLALLSCLTVPASAYQVRNSSGLYHVTNDCPN

SSIVYEAADAILHTPGCVPCVREGNTSRCWVAVTPTVATRDGKLPTTQLRRHID

LLVGSATLCSALYVGDLCGSVFLVGQLFTFSPRRHWTTQDCNCSIYPGHITGHR

MAWDMMMNWSPTAALVVAQLLRIPQAILDMIAGAHWGVLAGIAYFSMVGNWA

KVLLVLLLFAGVDAETHVTGGSAAKDTSGFTSLFRIGARQNIQLINSNGSWHINR

TALNCNASLDTGWVAGLFYYHKFNSSGCPERMASCRPLTDFAQGWGPISYAN

GSGPEHRPYCWHYPPKPCGIVPAQNVCGPVYCFTPSPVWGTTDKSGAPTYN

WGSNDTDVLVLNNTRPPSGNWFGCTWMNSSGFTKVCGAPPCVIGGVGNNTL

HCPTDCFRKHPDATYSRCGSGPWLTPRCLVDYPYRLWHYPCTVNYTLFKVRM

YVGGVEHRLEVACNWTRGERCDLDDRDRSELSPLLLSTTQWQVLPCSFTTLP

ALTTGLIHLHQNIVDVQYLYGVGSSIVSWAIKWEYVILLFLLLADARICSCLWMML

LISQAEAALENLWLNAASLAGTHGLASFLVFFCFAWYLKGKWVPGAAYAFYG

MWPLLLLLLALPQRAYALDTEMAASCGGWLVGLMALTLSPYYKRYISWCLWW

-continued

```
LQYFLTRVEAQLHVWVPPLNVRGGRDAVILLTCWHPALVFDITKLLLAVFGPLW
ILQTSLLKVPYFVRVQGLLRLCALARKMAGGHYVQMVIIKLGALTGTYVYNHLTP
LRDWAHNGLQDLAVAVEPVVFSQMETKLITWGADTAACGDIIDGLPVSARRGR
EILLGPADGMDSKGWRLLAPITAYAQQTRGLLGCIVTSLTGRDKNQVEGEVQIV
STAAQTFLATCINGVCWTVYHGAGTRTIASSKGPVIQMYTNVDKDLVGWPAPQ
GARSLTPCTCGSSDLYLVTRHADVIPVRRRGDSRGSLLSPRPISYLKGSSGGPL
LCPAGHAVGIFRAAVCTRGVAKAVDFIPVESLETTMRSPVFTDNSSPPAVPQSF
QVAYLHAPTGSGKSTKVPAAYAAQGYKVLVLNPSVAATLGFGAYMSKAHGIDP
NIRTGVRTITTGSSITYSTYGKFLADGGCSGGAYDIIICDECHSTDATSVLGIGTV
LDQAETAGVRLTVLATATPPGSVTVPHPNIEEAALSTTGEIPFYGKAIPLEAIKGG
RHLIFCHSKRKCDELAAKLVALGVNAVAYYRGLDVSVIPTSGDVVVVATDALMT
GYTGDFDSVIDCNTCVTQSVDFSLDPTFTIETTTLPQDAVSRTQRRGRTGRGKP
GIYRFVAPGERPSGMFDSSILCECYDAGCAWYELTPAETTVRLRSYMNTPGLP
VCQDHLEFWEGVFTGLTHIDAHFLSQTKQSGENLPYLVAYQATVCARAQALPP
SWDQMWKCLTRLKPTLHGPTPLLYRLGAVQNEITLTHPVTKYIMTCMSADLEVV
TSTWVLVGGVLAALTAYCLSTGCVVIVGRVVLSGKPAIIPDREVLYREFDEMEE
CSQHLPYIEQGMMLAEQFKQKAFGLLQTASRQAEVIAPAVQTNWQKLEAFWAK
HMWNFISGIQYLAGLSTLPGNPAIASLMAFTAAVTSPLTTSQTLLFNILGGWVAA
QLAAPGAATSFVGAGLAGAAVGSVGLGKVLIDILAGYGAGVAGALVAFKIMSGE
VPSTEDLVNLLPAILSPGALVVGWCAAILRRHVGPGEGAVQWMNRLIAFASRG
NHVSPTHYVPESDAAARVTTILSSLTVTQLLRRLHQWVSSESTTPCSGSWLRD
VWDWICEVLSDFKIWLKAKLMPQLPGIPFVSCQRGYKGVWRGDGVMHTRCHC
GAEITGHVKNGTMRIVGPKTCRNMWSGTFPINAYTTGPSTPLPAPNYTFALWR
VSAEEYVEIRQVGDFHYVTGMTTDNLKCPCQVPSPEFFTELDGVRLHRYAPPC
KPLLREEVSFRVGLHDYPVGSQLPCEPEPDVAVLTSMLTDPSHITAEAARRRLA
RGSPPSVASSSASQLSAPSLKATCTTNHDSPDAELIEANLLWRQEMGGNITRV
ESENKVWLDSFDPLVAEEDEREISVPAEILRKSRRFAPALPIWARPDYNPPLLE
TWKKPDYEPPWHGCPLPPPQSPPVPPPRRKRTWLTESTVSTALAELATKSF
GSSSTSGITGDNTTTSSEPASSGCPPDSDAESYSSMPPLEGEPGDPDLSDGS
WSTVSSEAGTEDWCCSMSYSWTGALITPCAAEEQKLPINALSNSLLRHHNLVY
STTSRSACLRQKKVTFDRLQVLDNHYQDVLKEVKAAASTVKANLLSVEEACSLT
PPHSARSKFGYGAKDVRCHARKAVNHINSVWKDLLEDNVTPIDTTIMAKNEVFC
VQPEKGGRKPARLIVYPDLGVRVCEKMALYDWSKLPLAVMGSSYGFQYSPAQ
RVEFLVQAWKSKRTPMGFSYDTRCFDSTVTESDIRTEEAIYQCCDLDPQARVAI
KSLTERLYVGGPLTNSKGENCGYRRCRASGVLTTSCGNTLTCYIKAQAACRAA
GLRDCTMLVCGDDLVVICESQGVQEDAANLRAFTEAMTRYSAPPGDPPQPEY
DLELITSCSSNVSVAHDGTGKRVYYLTRDPTTPLARAAWETARHTPINSWLGNII
MFAPTLWVRMILLTHFFSVLIARDQLEQALDCEIYGACYSIEPLDLPPIIQRLHGL
SAFSLHSYSPGEINRVATCLRKLGVPPLRTWRHRARSVRARLLSRGGRAAICG
RYLFNWAVKTKLKLTPIAAAGQLDLSGWFTAGYSGGDIYHSVSRARPRWFWFC
LLLLTAGVGIYLLPNR
```

Design19.mosaic1 Amino Acid Sequence
SEQ ID NO: 15

MSTNPKPQRKTKRNTNRRPQDVKFPGGGQIVGGVYLLPRRGPRLGVCATRKT

SERSQPRGRRQPIPKARRSEGRTWAQPGFPWPLYGNEGCGWAGWLLSPRG

SRPNWGPTDPRRRSRNLGKVIDTLTCGFADLMGYIPLVGAPLGGVARALAHGV

RVLEDGVNYATGNLPGCSFSIFLLALLSCLTVPASAYQVRNSSGLYHVTNDCPN

SSIVYETADTILHSPGCVPCVREGNASKCWVAVAPTVATRDGRLPTTQLRRHID

LLVGSATLCSALYVGDLCGSIFLVGQLFTFSPRRHWTTQDCNCSMYPGHITGH

RMAWDMMMNWSPTTALVMAQLLRIPQAILDMIAGAHWGVLAGMAYFSMVGN

WAKVLVVLLLFAGVDAETHVTGGSAAKDTSGFTSLFRIGARQNIQLINSNGSWH

INRTALNCNASLDTGWVAGLFYYHKFNSSGCPERMASCRPLADFDQGWGPIS

YANGSGPEHRPYCWHYPPKPCGIVPAQSVCGPVYCFTPSPVWGTTDRSGAP

TYSWGENDTDVLVLNNTRPPSGNWFGCTWMNSTGYTKVCGAPPCAIGGVGN

NTLRCPTDCFRKHPEATYARCGSGPWITPRCLVHYPYRLWHYPCTVNYTLFKV

RMYVGGVEHRLEVACNWTRGERCDLDDRDRSELSPLLLSTTQWQVLPCSFTT

LPALTTGLIHLHQNIVDVQYLYGVGSSIVSWAIKWEYVILLFLLLADARICSCLWM

MLLISQAEAALENLVLLNAASLAGMHGLASFLVFFCFAWYLKGRWVPGAAYALY

GMWPLLLLLLALPQRAYALDTEMAASCGGWLVGLMALTLSPYYKHYISWCLW

WLQYLLTRAEAQLHVWVPPLDARGGRDAVILLTCWHPTLIFDITKLLLAVLGPL

WILQASLLKVPYFVRVQGLLRICALARKMVGGHYVQMAIIKLGALTGTYVYNHLT

PLRDWAHNSLQDLAVAVEPVVFSQMETKLITWGADAAACGDIINGLPVSARRG

QEILLGPADGMVSKGWRLLAPITAYAQQTRGLLGCIITSLTGRDKNQAEGEVQIV

STATQTFLATCINGVCWSIYHGAGTRTIASPKGPVIQMYTNVDKDLVGWPAPQG

TRSLTPCACGSSDLYLVTRHADVIPVHRRGDSRGSLLSPRPISYLKGSSGGPLL

CPAGHAVGIFRAAVCTRGVAKAVDFIPVENLETTMRSPVFTDNSSPPAVPQSFQ

VAYLHAPTGSGKSTKVPAAYAAQGYKVLVLNPSVAATLSFGAYMSKAHGVEPN

IRTGVRTITTGSPITYSTYGKFLADGGCSGGAYDIIICDECHSTDATSILGIGTVLD

QAETAGARLTVLATATPPGSVTVPHPNIEEVGLSTTGEIPFYGKAIPLEAIKGGR

HLIFCHSKKKCDELAAKLVALGVNAVAYYRGLDVSIIPTSGDVVVVATDALMTGF

TGDFDSVIDCNTCVTQTVDFSLDPTFTIETTTLPQDAVSRTQRRGRTGRGKPGI

YRFVAPGERPSGMFDSSILCECYDAGCAWYELTPAETTVRLRSYMNTPGLPVC

QDHLEFWEGVFTGLTHIDAHFLSQTKQGGENFPYLVAYQATVCARAQAPPPS

WDQMWKCLVRLKPTLHGPTPLLYRLGAVQNEITLTHPITKYIMTCMSADLEIVTS

TWVLVGGVLAALAAYCLSTGCVVIVGRIVLSGKPAVIPDREVLYREFDEMEECS

QHLPYIEHGMMLAEQFKQKALGLLQTASRQAEVITPWQTNWQKLEAFWAKHM

WNFISGIQYLAGLSTLPGNPAIASLMAFTAAVTSPLTTSQTLLFNVLGGWVAAQL

AAPGAATSFVGAGLAGAAVGSVGLGKVLVDIIAGYGAGVAGALVAFKIMSGEVP

STEDLVNLLPAILSPGALVVGVVCAAILRRHVGPGEGAVQWMNRLIAFASRGNH

VSPTHYVPESDAAARVTNILSSLTVTQLLRRLHQWVSSECTTPCSDSWLRDIW

DWICEVLSDFKTWLKAKLVPQLPGIPFVSCQRGYKGVWRGDGVMHTRCHCGA

EIAGHVKNGTMRIVGPKTCRNMWSGTFPINAYTTGPSTPLPAPNYTFALWRVS

AEEYVEVRQVGDFHYVTGMTTDNLKCPCQVPSPEFFTELDGVRIHRFAPPCKP

-continued

```
LLRDEVSFRVGLHDYPVGSQLPCEPEPDVTVVTSMLTDPSHITAEAAGRRLAR
GSPPSVASSSASQLSAPSLKATCTANHDSPDAELIEASLLWRQEMGSNITRVES
ENKVVVLDSFDPLVAEEDEREVSVPAEILRKSRRFTPALPIWARPDYNPPLLET
WKKPDYEPPWHGCPLPPPRSPPVPPPRRKRTWLTESSVSTALAELATKSFG
SSSTSGITGDDTTTPSEPAPSACPPDSDAESCSSMPPLEGEPGDPDLSDGSWS
TVSSGADTEDVVCCSMSYSWTGALITPCAAEEQKLPINALSNSLLRHHNLVYST
TSRSACLRQKKVTFDRLQVLDSYYQDVLKEVKAAASTVKANLLSVEEACSLTPP
HSARSKFGYGAKDVRSHARKAVNHINSVWEDLLEDNVTPIDTTIMAKNEVFCVQ
PEKGGRKPARLIVFPDLGVRVCEKRALYDVVSKLPVAVMGSSYGFQYSPGQRV
EFLVQAWKSKKTPMGFSYDTRCFDSTVTESDIRTEEAIYQCCDLDPQARVVIKS
LTERLYVGGPLTNSKGENCGYRRCRASGVLTTSCGNTLTCYIKAKAACRAAGL
RDCTMLVCGDDLVVICESQGVQEDAASLRAFTEAMTRYSAPPGDPPQPEYDLE
LITSCSSNVSVAHDGTGKRVYYLTRDPTTPLARAAWETARHTPINSWLGNIIMFA
PTLWARMILMTHFFSVLIARDQLEQALDCEIYGACYSIEPLDLPLIIQRLHGLSAF
SLHSYSPGEINRVAACLRKLGVPPLRAWRHRARSVRARLLSRGGKAAICGKYL
FNWAVRTKLKLTPIAAASQLDLSGWFTAGYSGGDIYHSVSRARPRWIWFCLLLL
TAGVGIYLLPNR

Design19.mosaic2 Amino Acid Sequence
                                             SEQ ID NO: 16
MSTNPKPQRRTKRNTNRRPQDVKFPGGGQIVGGVYLLPRRGPRLGVRTTRKT
SERSQPRGRRQPIPKARRPEGRTWAQPGYPWPLYGNESCGWAGWLLSPRG
SRPSWGPSDPRRRSRNLGRVIDTLTCGFADLMGYIPFVGAPLGGAARALAHGV
RVLEDGVNYATGNLPGCSFSIFLLALLSCLTVPASAYQVRNSSGIYHVTNDCPN
SSIVYETADAILHSPGCVPCVREGNTSRCWVAMTPTVATRDGKLPATQLRRHID
LLVGGATLCSALYVGDLCGSVFLVSQLFTFSPRRHWTTQGCNCSIYPGHITGHR
MAWDMMMNWSPTAALVVAQLLRIPQAIMDMIAGAHWGVLAGIAYFSMVGNWA
KVLLVLLLFAGVDAGTHVTGGSAAKDTSGFTSLFRIGARQNIQLINSNGSWHINR
TALNCNESLNTGWLAGLFYQHKFNSSGCPERLASCRPLTDFAQGWGPISHAN
GSGPDQRPYCWHYPPRPCGIVPAQNVCGPVYCFTPSPVWGTTNKLGAPTYN
WGENETDVFVLNNTRPPLGNWFGCTWMNSTGFTKVCGAPPCVIGGVGNNTLL
CPTDCFRKHPDATYSRCGSGPWITPRCLVNYPYRLWHYPCTINYTIFKVRMYV
GGVEHRLDAACNWTRGERCDLEDRDRSELSPLLLTTTQWQVLPCSFTSLPALS
TGLIHLHQNIVDVQYLYGVGSSIASWAIKWEYVVLLFLLLADARVCSCLWMMLLI
SQVEAALENLVILNAASLAGTHGLASFLVFFCFAWHLKGRWVPGAVYALYGMW
PLLLLLLALPQRAYALDTEVAASCGGAVLVGLMALTLSPYYKRYISWCMWWLQ
YFLTRVEAQLHVWVPPLNVRGGRDAVILLMCWHPTLVFDITKLLLAIFGPLWIL
QASLLKVPYFVRVQGLLRVCALARKMAGGHYVQMVIIKLGALTGTYIYNHLTPLR
DWAHNGLQDLAVAVEPVVFSRMETKLITWGADTAACGDIINGLPVSARKGREIL
LGPADGMASKGWRLLAPITAYAQQTRGLLGCIITSLTGRDKNQVEGEIQIVSTAA
QTFLATCINGVCWTVYHGAGTRTIASSKGPVIQMYTNVDQDLVGWPAPQGSRS
```

-continued

LTPCTCGSSDLYLVTRHADVIPVRRRGDSRGSLLSPRPISYLKGSSGGPLLCPA

GHAAGIFRAAVCTRGVAKAVDFIPVEGLETTMRSPVFTDNSSPPWPQSFQVA

HLHAPTGSGKSTKVPAAYAAQGYKVLVLNPSVAATLGFGVYMSKAHGVDPNIR

TGVRTITTGSPITYSTYGKFLADGGCSGGAYDIIICDECHSTDATSVLGIGTVLDQ

AETAGVRLTVLATATPPGSVTVSHPNIEEVALSTTGEIPFYGKAIPLEVIKGGRHL

IFCHSKKKCDELAAKLVALGINAVAYYRGLDVSVIPTSGDVVVVSTDALMTGFTG

DFDSVIDCNTCVTQSVDFSLDPTFTIETITLPQDAVSRTQRRGRTGRGRPGIYRF

VAPGERPSGIFDSSVLCECYDAGCAWYELTPAETTVRLRAYMNTPGLPVCQDH

LEFWEGVFTGLTHIDAHFLSQTKQSGENLPYLVAYQATVCARARAPPPSWDQM

WKCLIRLKPTLHGPTPLLYRLGAVQNEVTLTHPVTKYIMTCMSADLEWTSTWV

LVGGVLAALAAYCLSTGCVVIVGRIVLSGKPAIVPDREVLYREFDEMEECSQHLP

YIEQGMALAEQFKQKALGLLQTASRQAEVITPAVQTNWQKLEVFWAKHMWNFI

SGIQYLAGLSTLPGNPAIASLMAFTAAVTSPLTTGQTLLFNILGGWLAAQLAAPG

AATAFVGAGLAGAAIGSVGLGKVLVDILAGYGAGVAGALVAFKIMSGDVPSTED

LVNLLPAILSPGALVVGWCAAILRRHVGPGEGAVQWMNRLIAFASRGNHVSPT

HYVPESDAAARVTAILSSLTVTQLLRRLHQWISSECTTPCSGSWLRDVWDWIC

EVLSDFKTWLKAKLMPQLPGIPFVSCQRGYRGVWQGDGIMHTRCHCGAEITG

HVKNGTMRIAGPRTCRNMWSGTFPINAYTTGPCTPLPAPNYSFALWRVSAEEY

VEIRRVGDFHYVSGMTTDNLKCPCQIPSPEFFTELDGVRLHRYAPPCKPLLRDE

VSFRVGLHAYPVGSQLPCEPELDVAVLTSMLTDPSHITAEAARRRLARGSPPS

MASSSASQLSAPSLKGTCTANHDSPDAELIEANLLWRQEMGGNITRVESENKV

VILDSFEPLVAEEDEREISVPAEILRKSRRFAPALPIWARPDYNPPLVETWKKPD

YEPPVVHGCPLPPPQSPPVPPPRKKRTVVLTESTLSTALAELATRSFGSSSTSG

ITGDNTTTSSEPAPSGCPPDSDVESYSSMPPLEGEPGDPDLSDGSWSTVSSG

ADAEDWCCSMSYSWTGALVTPCAAEEQKLPINALSNSLLRHHNMVYSTTSRS

ASQRQKKVTFDRLQVLDSHYQDVLKEVKAAASKVKASLLSVEEACSLTPPHSA

KSKFGYGAKDVRCHARKAVAHINSVWKDLLEDSETPIDTTIMAKNEVFCVQPEK

GGRKPARLIVYPDLGVRVCEKMALYDWSKLPLAVMGSSYGFQYSPAQRVEFL

VQAWKSKKNPMGFSYDTRCFDSTVTENDIRTEEAIYQCCDLDPQARVAIKSLTE

RLYVGGPLTNSRGENCGYRRCRASGVLTTSCGNTLTCYIKARAACRAAGLQDC

TMLVCGDDLVVICESAGVQEDAASLRAFTEAMTRYSAPPGDPPQPEYDLELITS

CSSNVSVAHDGAGKRVYYLTRDPTTPLARAAWETAKHTPVNSWLGNIIMFAPT

LWARMILMTHFFGVLIARDQLEQALNCEIYGACYSIEPLDIPPIIQRLHGLSAFSLH

SYSPGEINRVAACLRKLGVPPLRAWRHRARNVRARLLSRGGRAAICGKYLFNW

AVKTKLKLTPIAAAGRLDLSGWFTAGYSGGDIYHSVSHARPRWFWFSLLLLAAG

VGIYLLPNR

Design19.mosaic3 Amino Acid Sequence
SE ID NO: 17
MSTNPKPQRQTKRNTNRRPQDVKFPGGGQIVGGVYLLPRRGPRLGVRATRKT

SERSQPRGRRQPIPKARRPEGRSWAQPGYPWPLYGNEGCGWAGWLLSPRG

-continued

SRPSWGPTDPRRRSRNLGKVIDTLTCGLADLMGYIPLVGAPLGGAARALAHGV
RVLEDSVNYATGNLPGCSFSIFLLALLSCLTVPTSAYQVRNSTGLYHVTNDCPN
SSIVYEAADAILHTPGCVPCVREGNASRCWVAVTPTVATRDGKLPTTQLRRHID
LLVGSATLCSALYVGDLCGSVFLVGQLFTFSPRHHWTTQDCNCSIYPGHITGHR
MAWDMMMNWSPTTALVVAQLLRVPQAILDMIAGAHWGVLAGLAYFSMVGNW
AKVIWLLLFAGVDAGTHVTGGSAAKDTSGFTSLFRIGARQNIQLINTNGSWHIN
STALNCNDSLNTGWIAGLFYHHKFNSSGCSERLASCRPLTDFDQGWGPISYTN
GSGPDHRPYCWHYPPKPCGIVPAKSVCGPVYCFTPSPVVVGTTDKSGAPTYN
WGENDTDVFVLNNTRPPLGNWFGCTWMNSSGFTKVCGAPPCVIGGVGNNTL
HCPTDCFRKHPEATYSRCGSGPWLTPRCLVDYPYRLWHYPCTINYTIFKIRMYV
GGVEHRLEAACNWTRGERCNLDDRDRSELSPLLLSTTQWQILPCSFTTLPALS
TGLIHLHQNVVDVQYLYGVGSSIASWAIKWDYVVLLFLLLADARVCSCLWMMLL
ISQAEAALENLVVLNAASLAGTHGLVSFLVFFCFAWYLKGKWVPGAVYAFYGM
WPLLLLLLALPQRAYAQDTEVAASCGGWLAGLMALTLSPHYKRYISWCLWWL
QYFLTRAEALLHVWVPPLNVRGGRDAIILLMCVVHPALVFDITKLLLAVFGPLWIL
QTSLLKVPYFVRVQGLLRLCALVRKMAGGHYVQMAIIKVGALTGTYVYNHLTPL
RDWAHNGLRDLAVAVEPWFSPMETKLITWGADTAACGDIIDGLPVSARRGREI
LLGPADGVVSKGWRLLAPITAYAQQTRGLLGCIVTSLTGRDKNQVEGEVQIVST
AAQTFLATCVNGVCWTVYHGAGTRTLASSKGPVIQMYTNVDQDLVGWPAPQG
ARSLTPCTCGSSDLYLVTRHADVIPVRRRGDGRGSLLSPRPISYLKGSSGGPLL
CPAGHAVGLFRAAVCTRGVAKAVDFIPVESLETTMRSPVFSDNSSPPAVPQCY
QVAHLHAPTGSGKSTKVPAAYAAQGYTVLVLNPSVAATLGFGAYMSKAHGIDP
NIRTGVRTITTGSSITYSTYGKFLADGGCSGGAYDIIICDECHSTDATSILGIGTAL
DQAETAGARLVVLATATPPGSITVPHPNIEEVALSTTGEIPFYGKAIPLETIKGGR
HLIFCHSKKKCDELAAKLTALGINAVAFYRGLDVSVIPASGDWVATDALMTGY
TGDFDSVIDCNTCVTQTVDFSLDPTFTIETTTLPQDAVSRTQRRGRTGRGKPGI
YRFVTPGERPSGMFDSSVLCECYDTGCAWYELTPAETTVRLRAYMNTPGLPV
CQDHLEFWEGVFTGLTHIDAHFLSQTKQSGENFPYLVAYQATVCARAQALPPS
WDQMWKCLTRLKPTLHGPTPLLYRLGAVQNEVTLTHPITKYIMTCMSADLEWT
STWVLVGGVLAALTAYCLSTGCVVIVGRVVLSGKPAIIPDREVLYQEFDEMEEC
SQHLPYIEQGMMLAEQFKQKAFGLLQTASRQAEVIAPAVQTNWQRLETFWAKH
MWNFISGIQYLAGLSTLPGNPAIASLMAFTAAVTSPLTTSQTLLFNILGGWVAAQ
LAAPGAATAFVGAGLTGAAIGSVGLGKVLIDILAGYGAGVAGALVAFKIMSGEVP
STEDMVNLLPAILSPGALWGWCAAILRRHVGPGEGAVQWMNRLIAFASRGN
HVSPTHYVPESDAAARVTTILSSLTVTQLLRRLHQWISSESTTPCSGSWLRDIW
DWICEVLSDFKIWLKAKLMPQLPGIPLVSCQRGYRGVWRGDGIMHTRCHCGAE
ITGHVRNGTMRIVGPRTCRNMWNGTFPINAYTTGPCTPLPAPNYKFALWRVSA
EEYVEIRQVGDFHYVTGMTADNLKCPCQVPSPEFFTELDGVRLHRFAPPCKPL
LREEVSFRVGLHEYPVGSQLPCEPEPDVAVLTSMLTDPSHITAETAKRRLARGS
PPSEASSSASQLSAPSLKATCTTNHDSPDAELLEANLLWRQEMGGDITRVESK

```
NKVVILDSFDPLVAEEDEREISVPAEILRKSRRFAQALPVWARPDYNPPLIETWK
KPDYEPPWHGCPLPPPKSPPVPPPRRKRTVVLTESTVSTALAELATKSFGSSS
TSGVTGDNTTTSSEPASSGCPPDSDAESYSSMPPLEGEPGDPDLSDGSWSTV
SSEAGTEDWCCSMSYTWTGALITPCAAEEQKLPINALSNSLLRYHNLVYSTTS
RSACQRQKKVTFDRLQVLDNHYQDVLKEVKAAASKVKANLLSVEEACDLTPPH
SAKSKFGYGAKDVRCHARKAVNHINSVWKDLLEDSVTPIDTTIMAKNEVFCVQP
EKGGRKAARLIVFPDLGVRVCEKMALYDVVSKLPQAVMGSSYGFQYSPGQRV
EFLVQAWKSKRTPMGFSYDTRCFDSTVTESDIRMEEAIYQCCDLDPQARVAIR
SLTERLYVGGPLTNSRGENCGYRRCRASGVLTTSCGNTLTCYIKAQAACRAAG
LQNCTMLVCGDDLVVICESEGVQEDAANLRAFTEAMTRYSAPPGDPPQPEYDL
ELITSCSSNVSVAHDDAGKRVYYLTRDPTTPFARAAWETARHTPVNSWLGNIIM
FAPTLWVRMIMMTHFFSVLMARDQLEQALDCEIYGACYSIEPLDLPPIIQRLHGL
SAFSLHSYSPGEINRVATCLRKLGVPPLRAWRHRARSVRAKLLSRGGRAAICG
RYLFNWAVRTKLNLTPIAAAGQLDLSGWFTAGYSGGDIYHSVSRARPRWFWF
CLLLLAAGVGIYLFPNR

Design20.mosaic1 Amino Acid Sequence
                                                 SEQ ID NO: 18
MSTNPKPQRRTKRNTNRRPQDVKFPGGGQIVGGVYLLPRRGPRLGVRTTRKT
SERSQPRGRRQPIPKARRPEGRSWAQPGYPWPLYGNEGCGWAGWLLSPRG
SRPSWGPTDPRRRSRNLGKVIDTLTCGLADLMGYIPFVGAPLGGAARALAHGV
RVLEDGVNYATGNLPGCSFSIFLLALLSCLTVPASAYQVRNSSGIYHVTNDCPN
SSIVYETADAILHSPGCVPCVREGNASRCWVAVTPTVATRDGKLPTTQLRRYID
LLVGSATLCSALYVGDLCGSVFLVSQLFTFSPRRHWTTQDCNCSIYPGHVTGH
RMAWDMMMNWSPTTALIVAQLLRVPQAILDMIAGAHWGVLAGIAYYSMVGNW
AKVVVVLLLFAGVDAGTHVTGGSAAKDTSGFTSLFRIGARQNIQLINSNGSWHI
NSTALNCNDSLNTGWIAGLFYHHKFNSSGCPERLASCRPLTDFAQGWGPISYA
NGSGPDQRPYCWHYPPKPCGIVPAKSVCGPVYCFTPSPVAVGTTDRSGAPTY
NWGENDTDVFVLNNTRPPLGNWFGCTWMNATGFTKVCGAPPCAIGGVGNNT
LRCPTDCFRKHPEATYARCGSGPWLTPRCLVDYPYRLWHYPCTINYTIFKVRM
YVGGVEHRLEVACNWTRGERCNLDDRDRSELSPLLLSTTQWQVLPCSFTPMP
ALSTGLIHLHQNIVDVQYLYGVGSSIASWAIKWDYVVLLFLLLADARVCSCLWM
MLLISQAEAALENLVILNAASLAGTHGLVSFLVFFCFAWYLKGRWVPGAVYAVY
GMWPLLLLLLALPQRAYALDTEVAASCGGWLVGLMALTLSPYYKRYISWCMW
WLQYFLTRVEAQLHVWVPPLNVRGGRDAVILLTCWHPTLVFDITKLLLAIFGPL
WILQASLLKVPYFVRVQGLLRICALARKIAGGHYVQMAIIKVGALTGTYVYDHLT
PLRDWAHNGLRDLAVAVEPVVFSKMETKLITWGADTAACGDIIDGLPVSARRG
REVLLGPADGMVSRGWRLLAPITAYAQQTRGLLGCIITSLTGRDKNQVEGEVQI
VSTATQTFLATCINGACWTVYHGAGTRTIASPKGPVIQMYTNVDKDLVGWPAP
QGTRSLTPCTCGSSDLYLVTRHADVIPVCRRGDSRGSLLSPRPISYLKGSSGGP
LLCPAGHAAGIFRAAVCTRGVAKAVDFIPVESLETTMRSPVFTDNSSPPVVPQS
```

```
-continued
FQVAHLHAPTGSGKSTKVPAAYAAQGYKVLVLNPSVAATLSFGAYMSKAHGVE

PNIRTGVRTITTGSPITYSTYGKFLADGGCSGGAYDIIICDECHSTDATSVLGIGT

ALDQAETAGARLWLATATPPGSVTVPHPNIEEVGLSTTGEIPFYGKAIPLETIKG

GRHLIFCHSKKKCDELAAKLVGLGLNAVAYYRGLDVSVIPASGDVVVVATDALM

TGYTGDFDSVIDCNTCVTQTVDFSLDPTFTIETTTLPQDAVSRTQRRGRTGRGK

PGTYRFVAPGERPSGMFDSSVLCECYDTGCAWYELTPAETTVRLRAYMNTPG

LPVCQDHLEFWEGVFTGLTHIDAHFLSQTKQSGESLPYLVAYQATVCARAQAP

PPSWDQMWKCLVRLKPTLHGPTPLLYRLGAVQNEVTLTHPITKYIMTCMSADL

EVVTSTWVLVGGVLAALAAYCLSTGCVVIVGRIVLSGKPAIIPDREVLYQEFDEM

EECSQHLPYIEQGMMLAEQFKQKALGLLQTASRQAEVITPVVQTNWQKLEVFW

AKHMWNFISGIQYLAGLSTLPGNPAIASLMAFTAAVTSPLTTGQTLLFNILGGWV

AAQLAAPGAATTFVGAGLAGAAIGSVGLGKVLVDIIAGYGAGVAGALVAFKIMS

GEVPSTEDLVNLLPAILSPGALWGWCAAILRRHVGPGEGAVQWMNRLIAFAS

RGNHVSPTHYVQESDAAARVTAILSSLTVTQLLRRLHQWVSSECTTPCSDSWL

RDIWDWICEVLSDFKTWLKAKLMPQLPGIPFVSCQRGYRGVWQGDGIMHTRC

PCGAEIAGHVKNGTMRIVGPKTCRNMWSGTFPINAYTTGPCTPLPAPNYKFAL

WRVSAEEYVEIRRVGDFHYVTGMTTDDLKCPCQVPSPEFFTELDGVRLHRFAP

PCKPLLREEVTFRVGLHDYPVGSQLPCEPEPDVAVLTSMLTDPSHITAEAARRR

LARGSPPSEASSSASQLSAPSLKATCTTNHDSPDAELIEASLLWRQEMGGNITR

VESENKWILDSFDPLTAEEDEREISVAAEILRKSRRFTPALPIWARPDYNPPLLE

TWKKPDYEPPVVHGCPLPPPKSPPVPPPRKKRTVVLTESNLSTALAELATRSF

GSSSTSGITGDNTTTSSEPAPSGCPPDSDVESYSSMPPLEGEPGDPDLSDGS

WSTVSSGADTEDVVCCSMSYTWTGALVTPCAAEEQKLPINALSNSLLRHHNLV

YSTTSRSACQRQKKVTFDRLQVLDSYYQDVLKEVKAAASKVKANLLSVEEACD

LTPPHSAKSKFGYGAKDVRSHARKAVNHINSVWEDLLEDNVTPIDTTIMAKNEV

FCVQPEKGGRKPARLIVFPDLGVRVCEKMALYDWSKLPVAVMGSSYGFQYSP

GQRVEFLVQAWKSKKNPMGFSYDTRCFDSTVTESDIRMEEAIYQCCDLDPQA

RVAIKSLTERLYVGGPLTNSRGENCGYRRCRASGVLTTSCGNTLTCYIKARAAC

RAAGLQNCTMLVCGDDLWICESAGVQEDAASLRAFTEAMTRYSAPPGDPPQ

PEYDLELITSCSSNVSVAHDDAGKRVYYLTRDPTTPFARAAWETARHTPVNSW

LGNIIMFAPTLWARMILMTHFFSVLIARDQLEQALNCEIYGACYSIEPLDLPPIIQR

LHGLSAFSLHSYSPGEINRVAACLRKLGVPPLRAWRHRARSVRARLLSRGGRA

ATCGKYLFNWAVKTKLKLTPIAAASRLDLSGWFTAGYSGGDIYHSVSRARPRWI

WFCLLLLTAGVGIYLLPNR

Design20.mosaic2 Amino Acid Sequence
                                                SEQ ID NO: 19
MSTNPKPQRKTKRNTNRRPQDVKFPGGGQIVGGVYLLPRRGPRLGVRATRKT

SERSQPRGRRQPIPKARRPEGRTWAQPGHPWPLYGNESCGWAGWLLSPRG

SRPSWGPSDPRRRSRNLGKVIDTLTCGFADLMGYIPLVGAPLGGVARALAHGV

RVLEDGVNYATGNLPGCSFSIFLLALLSCLAVPASAYQVRNSSGLYHVTNDCSN
```

-continued

SSIVYETADTILHSPGCVPCVREGNASKCWVAVAPTVATRDGRLPTTQLRRHID

LLVGGATLCSALYVGDLCGSIFLVGQLFTFSPRHHWTTQGCNCSIYPGHITGHR

MAWDMMMNWSPTTALVVAQLLRVPQAILDMIAGAHWGVLAGIAYFSMVGNWA

KVLLVLLLFAGVDAGTHVTGGSAAKDTSGFTSLFRIGARQNIQLVNTNGSWHIN

RTALNCNASLDTGWVAGLFYYHKFNSSGCPERMASCRPLADFDQGWGPISHA

NGSGPDQRPYCWHYAPKPCGIVPAQSVCGPVYCFTPSPVWGTTDKSGAPTY

NWGANDTDVLVLNNTRPPLGNWFGCTWMNSSGYTKVCGAPPCVIGGVGNNT

LLCPTDCFRKHPEATYSRCGSGPWITPRCLVNYPYRLWHYPCTINYTVFKVRM

YVGGVEHRLDAACNWTRGERCNLEDRDRSELSPLLLSTTQWQVLPCSFATLP

ALSTGLIHLHQNVVDVQYLYGVGSSVASWAIKWEYVVLLFLLLADARICSCLWM

MLLISQVEAALENLWLNAASLAGAHGLVSFLVFFCFAWYLKGKWVPGAVYALY

GMWPLLLLLLALPQRAYAMDTEVAASCGGVVLAGLMVLTLSPYYKHYISWCLW

WLQYFLTRAEAQLHVWVPPLNVRGGRDAIILLMCVVHPTLVFDITKLLLAVLGPL

WILQASLLKVPYFVRVQGLLRICALARKMVGGHYVQMAIIKLGALTGTYIYNHLT

PLQDWAHNGLRDLAAAVEPVVFSRMETKLITWGADTAACGDIINGLPVSARKG

REILLGPADGVVSKGWRLLAPITAYAQQTRGLLGCI1TSLTGRDKNQAEGEVQIV

STAAQTFLATCVNGVCWTVYHGAGTRTIASSKGPVIQMYTNVDQDLVGWPAP

QGSRSLTPCTCGSSDLYLVTRHADVIPVRRRGDSRGGLLSPRPISYLKGSSGG

PLLCPEGHAVGIFRAAVCTRGVAKAVDFIPVENLETTMRSPVFTDNSTPPAVPQ

SYQVAHLHAPTGSGKSTKVPAAYAAQGYKVLVLNPSVAATLGFGAYMSKAHGI

DPNIRTGVRTITTGSSITYSTYGKFLADGGCSGGAYDIIICDECHSTDATSILGIGT

ALDQAETAGVRLTVLATATPPGSVTVPHHNIEEVALSTTGEIPFYGKAIPLEVIKG

GRHLIFCHSKKKCDELAAKLVALGVNAVAYYRGLDVSVIPTSGDVVVVATDALM

TGFTGDFDSVIDCNTCVTQSVDFSLDPTFTIETITLPQDAVSRTQRRGRTGRGK

PGIYRFVAPGERPSGIFDSSVLCECYDAGCAVVYELTPAETTVRLRAYMNTPGL

PVCQDHLEFWEGVFTGLTHIDAHFLSQTKQGGENFPYLVAYQATVCARAQALP

PSWDQMWKCLIRLKPTLHGSTPLLYRLGAVQNEVTLTHPVTKYIMTCMSADLE

VVTSTWVLVGGVLAALAAYCLSTGCVVIVGRIVLSGRPAIIPDREVLYREFDEME

ECSQHLPYIEQGMVLAEQFKQKALGLLQTASRQAEAITPAVQTNWQKLETFWA

KHMWNFISGIQYLAGLSTLPGNPAIASLMAFTAAVTSPLTTSQTLFFNILGGWVA

AQLAAPGAATAFVGAGLAGAAIGGVGLGKVLVDILAGYGAGVAGALVAFKIMSG

DVPSTEDLVNLLPAILSPGALVVGVVCAAILRRHVGPGEGAVQWMNRLIAFASR

GNHVSPTHYVPESDAATRVTAILSSLTVTQLLRRLHQWISSESTTPCSGSWLRD

IWDWVCEVLSDFKIWLKAKLMPQLPGVPFVSCQRGYKGVWRGDGIMHTRCHC

GAEIAGHVKNGTMRIVGPRTCRNMWNGTFPINAYTTGPCTPLPAPNYEFALWR

VSAEEYVEVRRVGEFHYVTGMTADNLKCPCQVPSPEFFTELDGVRLHRFAPPC

KPLLRDEVSFRVGLHEYPVGSQLPCEPEPDVSVLTSMLTDPSHITAETAGRRLA

RGSPPSLASSSASQLSAPSLKATCTANHDSPDAELLEANLLWRQEMGSNITRV

ESENKVVILDSFEPLVAEEDEREISVPAEILRKSRRFAPALPIWARPDYNPPLLEV

WKKPDYEPPVVHGCPLPPSQSPPVPPPRKKRTVVLTESTVSTALAELATKSFG

SSSTSGVTGDSTTTPSEPAPSACPPDSDAESCSSMPPLEGEPGDPDLSDGSW

```
-continued
STVSSEADAEDVVCCSMSYTWTGALITPCAAEEQKLPINALSNSLLRHHNMVYS

TTSRSACHRQKKVTFDRLQVLDDHYQDVLKEVKTAASKVKANLLSVEEACSLT

PPHSAKSKFGYGAKDVRCHARKAVAHINSVWKDLLEDSVTPIDTTIMAKNEVFC

VQPEKGGRKPARLIVYPDLGVRVCEKMALYDVVSKLPLAVMGSSYGFQYSPG

QRVEFLVQAWKSKRTPMGFSYDTRCFDSTVTESDIRTEEAIYQCCDLDPQARV

AIRSLTERLYVGGPLTNSRGENCGYRRCRASGVLTTSCGNTLTCYIKAKAACRA

AGLQDCTMLVCGDDLVVICESEGVQEDAANLRAFTEAMTRYSAPPGDPPQPE

YDLELITSCSSNVSVAHDGAGKRVYYLTRDPTTPLARAAWETAKHTPVNSWLG

NIIMFAPTLWVRMIMMTHFFSVLLARDQLEQALDCEIYGACYSIEPLDLPLIIQRL

HGLSAFSLHSYSPGEINRVATCLRKLGVPPLRAWRHRARNVRARLMSRGGRA

AICGKYLFNWAVRTKLKLTPIAAASQLDLSGWFTAGYSGGDIYHSVSRARPRWF

WFCLLLLAAGVGVYLLPNR

Design20.mosaic3 Amino Acid Sequence
                                              SEQ ID NO: 20
MSTIPKPQRKTKRNTNRRPQDVKFPGGGQIVGGVYLLPRRGPRLGVCATRKTS

ERSQPRGRRQPIPKARRSEGRTWAQPGYPWPLYGNEGCGWAGWLLSPRGS

RPSWGPNDPRRRSRNLGKVIDTLTCGFADLMGYIPFVGAPLGGAARALAHGVR

VLEDGVNYATGNLPGCSFSIFLLALLSCLTVPTSAYQVRNSTGLYHVTNDCPNS

SIVYETADAILHAPGCVPCVREGNTSRCWVAMTPTVATRDGKLPTKQLRRHIDL

LVGSATLCSALYVGDLCGSVFLIGQLFTFSPRRHWTTQGCNCSMYPGHITGHR

MAWDMMMNWSPTAALVVAQLLRIPQAIMDMIAGAHWGVLAGIAYFSMAGNWA

KVLVVLLLFAGVDAGTHVTGGSAAKDTSGFTSLFRIGARQNIQLINTNGSWHINS

TALNCNESLNTGWLAGLFYQHKFNSSGCPERLASCRRLTDFDQGWGPISYAN

GSGLDERPYCWHYPPRPCGIVPAKSVCGPVYCFTPSPVVVGTTDRSGAPTYS

WGANDTDVFVLNNTRPPLGNWFGCTWMNSTGFTKVCGAPPCVIGGVGNNTL

YCPTDCFRKHPDATYSRCGSGPWITPRCLVDYPYRLWHYPCTINYTIFKIRMYV

GGVEHRLEAACNWTRGERCDLEDRDRSELSPLLLSTTQWQILPCSFTTLPALS

TGLIHLHQNIVDVQYLYGVGSSIASWAIKWEYVVLLFLLLADARVCSCLWMMLLI

SQVEAALENLVLLNVASLAGTHGLASFLVFFCFAWHLKGRWVPGAAYALYGM

WPLLLLLLALPQRAYALDTEMAASCGGWLVGLMVLTLSPHYKRYISWCFWWL

QYFLTRVEAHLHVWVPPLDVRGGRDAVILLMCAVHPALVFDITKLLLAVFGPLWI

LQTSLLRVPYFVRVQGLLRLCALARKMAGGHYVQMVIIKLGALTGTYVYNHLTP

LRDWAHNGLQDLAVAVEPVVFSPMETKLITWGADTAACGDIINGLPVSARRGR

EILLGPADGMVSKGWRLLAPITAYAQQTRGLLGCIVTSLTGRDKNQAEGEVQIV

STAAQTFLATCINGVCWTVYHGAGTRTLASPKGPVIQMYTNVDKDLVGWPAPQ

GARSLTPCACGSSDLYLVTRHADVIPVRRRGDSRGSLLSPRPISYLKGSSGGPL

LCPAGHAVGIFRAAVCTRGVAKAVDFVPVESLETTMRSPVFTDNSSPPAVPQS

FQVAHLHAPTGSGKSTKVPAAYAAQGYTVLVLNPSVAATLGFGVYMSKAHGVD

PNIRTGVRTITTGSSITYSTYGKFLADGGCSGGAYDIIICDECHSTDATSILGIGTV

LDQAETAGARLTVLATATPPGSVTVSHPNIEEVALSTTGEIPFYGKAIPLDVIKGG
```

RHLIFCHSKKKCDELAAKLTALGINAVAFYRGLDVSVIPTSGNVVVVATDALMTG

YTGDFDSVIDCNTCVTQTVDFSLDPTFTIETTTLPQDAVSRTQRRGRTGRGKPG

IYRFVTPGERPSGMFDSSILCECYDAGCAWYELTPAETTVRLRSYMNTPGLPV

CQDHLEFWEGVFTGLTHIDAHFLSQTKQSGENFPYLVAYQATVCARAQAPPPS

WDQMWKCLNRLKPTLHGPTPLLYRLGAVQNEITLTHPITKYIMTCMSADLEIVTS

TWVLVGGVLAALAAYCLSTGCVVIVGRVVLSGKPAIIPDREVLYKEFDEMEEGS

QHLPYIEQGMALAEQFKQKALGLLQTASRQAEVITPAVQTNWQRLEAFWAKHM

WNFISGIQYLAGLSTLPGNPAIASLMAFTAAVTSPLTTSQTLLFNILGGWVASQL

AAPGAATSFVGAGLAGAAVGSVGLGKVLIDILAGYGAGVAGALVAFKIMSGEVP

STEDMVNLLPAILSPGALWGWCAAILRRHVGPGEGAVQWMNRLIAFASRGN

HVSPTHYVPESDAAARVTTILSSLTVTQLLRRLHQWISSECTTPCSGSWLREIW

DWICEVLSDFKTWLKAKLMPQLPGIPLVSCQRGYRGVWRGDGIMHTRCHCGA

EITGHVKNGTMRIVGPRTCRNTWSGTFPINAYTTGPSTPLPAPNYTFALWRVSA

EEYVEVRQVGDFHYVTGMTTDNLRCPCQVPSPEFFTELDGVRIHRFAPPCKPL

LREEVSFRVGLHAYPVGSQLPCEPEPDVAWTSMLTDPSHITAEAAGRRLARG

SPPSVASSSASQLSAPSLKATCTVNHDSPDADLIEANLLWRQEMGGNITRVESE

NKVVVLDSFDPLVAEEDEREVSVPAEILRKSRKFTPALPIWARPDYNPPLVETW

KKPDYEPPVVHGCPLPPPRSPPVPPPRRKRTWLTESSVSTALAELATKSFGSS

STSGITGDNTATSSEPAPSGCSPDSDAESYSSMPPLEGEPGDPDLSDGSWST

VSSEAGTEDVVCCSMSYSWTGALVTPCAAEEQKLPINALSNSLLRNHNLVYST

TSRSASQRQKKVTFDRLQVLDSHYQDVLKEVKAAASKVKASLLSVEEACNLTP

PHSAKSKFGYGAKDVRCHARKAVNHINSVWKDLLEDNVTPIDTTIMAKNEVFCV

QPEKGGRKAARLIVFPDLGVRVCEKMALYDLVSKLPLAVMGSSYGFQYSPGQR

VEFLVKAWKSKKTPMGFSYDTRCFDSTVTENDIRTEEAIYQCCDLDPQARVVIK

SLTERLYVGGPLTNSRGENCGYRRCRASGVLTTSCGNTLTCYIKAQAACRAAG

LRDCTMLVCGDDLVVICESAGVQEDAAGLRAFTEAMTRYSAPPGDPPQPEYDL

ELITSCSSNVSVAHDGTGKRVYYLTRDPTTPLARAAWETARHTPINSWLGNIIMF

APTLWVRMILLTHFFSVLIARDQLEQALDCEIYGACYSIEPLDLPLIIQRLHGLSAF

SLHSYSPGEINRVAACLRKLGVPPLRAWRHRARNVRARLLSRGGKAAICGKYL

FNWAVKTKLRLTPIAAAGRLDLSGWFTAGYSGGDIYHSVSHARPRWFWFCLLL

LAAGVGIYLLPNR

Design20.mosaic4 Amino Acid Sequence
                                        SEQ ID NO: 21
MSTNPKPQRQTKRNTNRRPQDVKFPGGGQIVGGVYLLPRRGPRLGVRATRKT

SERSQPRGRRQPIPKARRPEGRTWAQPGYPWPLYGNEGCGWAGWLLSPRG

SRPNWGPTDPRRRSRNLGKVIDTLTCGLADLMGYIPLVGAPLGGAARALAHGV

RVLEDSVNYATGNLPGCSFSIFLLALLSCLTVPASAHQVRNSTGLYHVTNDCPN

SSIVYEAADAILHTPGCVPCVREGNVSRCWVAITPTVATRDGKLPATQLRRHIDL

LVGSATLCSALYVGDLCGSVFLVGQLFTFSPRQHWTTQDCNCSMYPGHITGHR

MAWDMMMNWSPTTALVMAQLLRIPQAILDMIAGAHWGVLAGMAYFSMVGNW

-continued

AKVLVVLLLFAGVDAETHVTGGSAAKDTSGFTSLFRIGARQNIQLINSNGSWHIN
RTALNCNESLDTGWVAGLLYYHKFNSSGCPERMASCRSLADFDQGWGPISYA
NGSGPEHRPYCWHYPPKPCGIVPAQNVCGPVYCFTPSPVVVGTTDKAGAPTY
NWGENETDVFVLNNTRPPLGNWFGCTWMNSSGFTKVCGAPPCNIGGVGNNT
LHCPTDCFRKHPEATYARCGSGPWITPRCLVHYPYRLWHYPCTVNYTLFKVRM
YVGGVEHRLDVACNWTRGERCDLDDRDRSELSPLLLTTTQWQVLPCSFTTLP
ALTTGLIHLHQNIVDVQYLYGVGSSIVSWAIKWEYVILLFLLLADARICSCLWMML
LISQAEAALENLVLLNAASLAGMHGLASFLVFFCFAWYLKGKWVPGAAYAFYG
MWPLLLLLLALPQRAYALDSEVAASCGGAVLVGLMALTLSPHYKRYISWCLWW
LQYFLTRVEALLHVWVPPLNVRGGRDAVILLMCVVHPALVFDITKLLLAVFGPLW
ILQTSLLKVPYFVRVQGLLRICALVRKMAGGHYVQMAMIKVGALTGTYIYNHLTP
LRDWAHNSLQDLAVAVEPVVFSQMETKLITWGADTAACGDIINNLPVSARRGQ
EILLGPADGMASKGWRLLAPITAYAQQTRGLLGCIITSLTGRDKNQVEGEIQIVS
TAAQTFLATCINGVCWSIYHGAGTRTIASPNGPVIQMYTNVDQDLVGWPAPQG
ARSLTPCTCGSSDLYLVTRHADVIPVRRRGDGRGSLLSPRPISYLKGSSGGPLL
CPAGHAVGLFRAAVCTRGVAKAVDFIPVEGLETTMRSPVFSDNSSPPAVPQCY
QVAHLHAPTGSGKSTKVPAAYAAQGYKVLVLNPSVAATLGFGAYMSKAHGVD
PNVRTGVRTITTGSPITYSTYGKFLADGGCSGGAYDIIICDECHSTDATSVLGIGT
VLDQAETAGARLWLATATPPGSITVPHPNIEEVALSATGEIPFYGKAIPLEAIKG
GRHLIFCHSKKKCDELAAKLVALGINAVAYYRGLDVSVIPTSGDVVVVSTDALMT
GFTGDFDSVIDCNTCVTQTVDFSLDPTFTIETTTLPQDAVSRTQRRGRTGRGRP
GIYRFVAPGERPSGMFDSSVLCECYDAGCAVVYELTPAETTVRLRAYMNTPGLP
VCQDHLEFWEGVFTGLTHIDAHFLSQTKQSGENLPYLVAYQATVCARAQAPPP
SWDQMWKCLTRLKPTLHGPTPLLYRLGAVQNEITLTHPVTKYIMTCMSADLEVV
TSTWVLVGGVLAALTAYCLSTGCVVIVGRIVLSGKPAVIPDREVLYREFDEMEE
CSQHLPYIEHGMMLAEQFKQKALGLLQTASRQAEVIAPAVQTNWQKLEAFWAK
HMWNFISGIQYLAGLSTLPGNPAIASLMAFTAAVTSPLTTNQTLLFNILGGWLAA
QLAAPGAATAFVGAGLTGAAIGSVGLGKVLVDILAGYGAGVAGALVAFKIMSGE
TPSTEDLVNLLPAILSPGALVVGWCAAILRRHVGPGEGAVQWMNRLIAFASRG
NHVSPTHYVPESDAAARVTAILGSLTVTQLLRRLHQWISSDCTTPCSGSWLRDV
WDWICEVLSDFKTWLKAKLMPQLPGIPFVSCQRGYRGVWRGDGVMHTRCHC
GAEITGHVRNGTMRIVGPRTCRNMWSGTFPINAYTTGPCSPLPAPNYKFALWR
VSAEEYVEIRQVGDFHYVTGMTTDNLKCPCQIPSPEFFTELDGVRLHRYAPPCK
PLLREEVSFRVGLHDYPVGSQLPCEPEPDVTVVTSMLTDPSHITAEAAARRLAR
GSPPSMASSSASQLSAPSLKATCTTNHDSPDAELIEANLLWRQAMGGNITRVE
SENKWILDSFDPLVAEEDEREISVPAEILRKSRRFAQALPVWARPDYNPPLIET
WKKPDYEPPWHGCPLPPPQSPPVPPPRKKRTVVLTESTLSTALAELAAKSFG
SSSTSGITGDDTTTSSEPASSGCPPDSDAESYSSMPPLEGEPGDPDLSDGSW
STVSSGADAEDVVCCSMSYSWTGALITPCAAEEQKLPINALSNSLLRHHNLVYS
TTSRSACLRQKKVTFDRLQVLDNHYQDVLKEVKAAASTVKANLLSVEEACSLTP

-continued

PHSARSKFGYGAKDVRCHARKAVTHINSVWKDLLEDSVTPIDTTIMAKNEVFCV

QPEKGGRKPARLIVFPDLSVRVCEKMALYDWSKLPQAVMGSSYGFQYSPGQ

RVEFLVQAWKSKKTPMGFSYDTRCFDSTVTENDIRTEEAIYQCCDLDPQARVAI

KSLTERLYVGGPLTNSKGENCGYRRCRASGVLTTSCGNTLTCYIKAKAACRAA

GLRDCTMLVCGDDLVVICESQGVQEDAASLRAFTEAMTRYSAPPGDPPQPEY

DLELITSCSSNVSVAHDSAGKRVYYLTRDPTTPLARAAWETARHTPVNSWLGNI

IMFAPTLWARMILMTHFFSVLMARDQLEQALDCEIYGACYSIEPLDLPPIIQRLHG

LSAFSLHSYSPGEINRVATCLRKLGVPPLRAWRHRARSVRAKLLSRGGRAAICG

RYLFNWAVRTKLKLTPIAAAGQLDLSGWFTAGYSGGDIYHSVSRARPRWLWFC

LLLLAAGVGIYLLPNR

Design21.mosaic1 Amino Acid Sequence
                                       SEQ ID NO: 22
MSTNPKPQRKTKRNTNRRPQDVKFPGGGQIVGGVYLLPRRGPRLGVRATRKT

SERSQPRGRRQPIPKARQPEGRAWAQPGYPWPLYGNEGMGWAGWLLSPRG

SRPSWGPTDPRRRSRNLGKVIDTLTCGFADLMGYIPLVGAPLGGAARALAHGV

RVLEDGVNYATGNLPGCSFSIFLLALLSCLTIPASAYEVRNVSGVYHVTNDCSN

SSIVYEAADMIMHTPGCVPCVRENNSSRCWVALTPTLAARNASVPTTTIRRHVD

LLVGAAAFCSAMYVGDLCGSVFLVSQLFTFSPRRHETVQDCNCSIYPGHVSGH

RMAWDMMMNWSPTTALWSQLLRIPQAVVDMVAGAHWGVLAGLAYYSMVGN

WAKVLIVMLLFAGVDGHTHVTGGRVASSTQSLVSWLSQGPSQKIQLVNTNGS

WHINRTALNCNDSLQTGFLAALFYTHKFNASGCPERMASCRPIDEFAQGWGPI

THDMPESSDQRPYCWHYAPRPCGIVPASQVCGPVYCFTPSPVWGTTDRFGV

PTYSWGENETDVLLLNNTRPPQGNWFGCTWMNSTGFTKTCGGPPCNIGGVG

NNTLTCPTDCFRKHPEATYTKCGSGPWLTPRCLVDYPYRLWHYPCTVNFTIFK

VRMYVGGVEHRLNAACNWTRGERCDLEDRDRSELSPLLLSTTEWQILPCSFTT

LPALSTGLIHLHQNIVDVQYLYGIGSAWSFAIKWEYVLLLFLLLADARVCACLW

MMLLIAQAEAALENLVVLNAASVAGAHGILSFLVFFCAAWYIKGRLVPGAAYALY

GVWPLLLLLLALPPRAYAMDREMAASCGGAVFVGLALLTLSPHYKVFLARLIWW

LQYFITRAEAHLQVWIPPLNVRGGRDAIILLTCAVHPELIFDITKLLLAILGPLMVLQ

AGITRVPYFVRAQGLIRACMLVRKVAGGHYVQMAFMKLAALTGTYVYDHLTPL

RDWAHAGLRDLAVAVEPWFSDMETKIITWGADTAACGDIILGLPVSARRGREIL

LGPADSLEGQGWRLLAPITAYSQQTRGLLGCIITSLTGRDKNQVEGEVQVVSTA

TQSFLATCVNGVCWTVYHGAGSKTLAGPKGPITQMYTNVDQDLVGWQAPPGA

RSLTPCTCGSSDLYLVTRHADVIPVRRRGDSRGSLLSPRPVSYLKGSSGGPLL

CPSGHAVGIFRAAVCTRGVAKAVDFVPVESMETTMRSPVFTDNSSPPAVPQTF

QVAHLHAPTGSGKSTKVPAAYAAQGYKVLVLNPSVAATLGFGAYMSKAHGVD

PNIRTGVRTITTGAPITYSTYGKFLADGGCSGGAYDIIICDECHSTDSTTILGIGTV

LDQAETAGARLVVLATATPPGSVTVPHPNIEEVALSNTGEIPFYGKAIPIETIKGG

RHLIFCHSKKKCDELAAKLSGLGLNAVAYYRGLDVSVIPTSGDVVVVATDALMT

GFTGDFDSVIDCNTCVTQTVDFSLDPTFTIETTTVPQDAVSRSQRRGRTGRGR

```
RGIYRFVTPGERPSGMFDSSVLCECYDAGCAWYELTPAETSVRLRAYLNTPGL
PVCQDHLEFWESVFTGLTHIDAHFLSQTKQAGDNFPYLVAYQATVCARAQAPP
PSWDQMWKCLIRLKPTLHGPTPLLYRLGAVQNEVTLTHPITKYIMACMSADLEV
VTSTWVLVGGVLAALAAYCLTTGSVVIVGRIILSGKPAIIPDREVLYQEFDEMEEC
ASHLPYIEQGMQLAEQFKQKALGLLQTATKQAEAAAPVVESKWRALETFWAKH
MWNFISGIQYLAGLSTLPGNPAIASLMAFTASITSPLTTQHTLLFNILGGWVAAQL
APPSAASAFVGAGIAGAAVGSIGLGKVLVDILAGYGAGVAGALVAFKVMSGEMP
STEDLVNLLPAILSPGALWGWCAAILRRHVGPGEGAVQWMNRLIAFASRGNH
VSPTHYVPESDAAARVTQILSSLTITQLLKRLHQWINEDCSTPCSGSWLRDVWD
WICTVLTDFKTWLQSKLLPRLPGVPFFSCQRGYKGVWRGDGIMQTTCPCGAQI
TGHVKNGSMRIVGPKTCSNTWHGTFPINAYTTGPCTPSPAPNYSRALWRVAAE
EYVEVTRVGDFHYVTGMTTDNVKCPCQVPAPEFFTEVDGVRLHRYAPACKPLL
REEVTFQVGLNQYLVGSQLPCEPEPDVAVLTSMLTDPSHITAETAKRRLARGSP
PSLASSSASQLSAPSLKATCTTHHDSPDADLIEANLLWRQEMGGNITRVESENK
WILDSFDPLRAEEDEREVSVPAEILRKSRKFPRAMPIWARPDYNPPLLESWKD
PDYVPPWHGCPLPPTKAPPIPPPRRKRTWLTESTVSSALAELATKTFGSSES
SAVDSGTATAPPDQPSDDGDAGSDVESYSSMPPLEGEPGDPDLSDGSWSTV
SEEASEDVVCCSMSYTWTGALITPCAAEESKLPINALSNSLLRHHNMVYATTSR
SASQRQKKVTFDRLQVLDDHYRDVLKEMKAKASTVKAKLLSVEEACKLTPPHS
ARSKFGYGAKDVRNLSSKAVNHIRSVWKDLLEDTETPIDTTIMAKNEVFCVQPE
KGGRKPARLIVFPDLGVRVCEKMALYDWSTLPQAVMGSSYGFQYSPGQRVE
FLVNAWKSKKCPMGFAYDTRCFDSTVTENDIRVEESIYQCCDLAPEARQAIRSL
TERLYIGGPLTNSKGQNCGYRRCRASGVLTTSCGNTLTCYLKASAACRAAKLQ
DCTMLVCGDDLVVICESAGTQEDAASLRVFTEAMTRYSAPPGDPPQPEYDLELI
TSCSSNVSVAHDASGKRVYYLTRDPTTPLARAAWETARHTPVNSWLGNIIMYA
PTLWARMILMTHFFSILLAQEQLEKALDCQIYGACYSIEPLDLPQIIQRLHGLSAF
SLHSYSPGEINRVASCLRKLGVPPLRVWRHRARSVRAKLLSQGGRAATCGKYL
FNWAVRTKLKLTPIPAASQLDLSGWFVAGYSGGDIYHSLSRARPRWFMWCLLL
LSVGVGIYLLPNR

Design22.mosaic1 Amino Acid Sequence
                                                       Seq ID NO: 23
MSTNPKPQRKIKRNTNRRPQDVKFPGGGQIVGGVYLLPRRGPRLGVRATRKTS
ERPQPRGRRQPIPKARQPEGRAWAQPGYPWPLYGNEGLGWAGWLLSPRGS
RPSWGPTDPRRRSRNLGKVIDTLTCGLADLMGYIPLVGAPLGGVARALAHGVR
VLEDGVNYATGNLPGCSFSIFLLALLSCLTIPASAYEVRNVSGVYHVTNDCSNAS
IVYEAADMIMHTPGCVPCVRENNSSRCWVALTPTLAARNASVPTTTIRRHVDLL
VGTAAFCSAMYVGDLCGSVFLVAQLFTFSPRRHETVQDCNCSIYPGHVTGHR
MAWDMMMNWSPTAALVVSQLLRIPQAVMDMVAGAHWGILAGLAYYSMVGNW
AKVLWMLLFAGVDGGTHVTGGKVAYTTQGFTSFFSRGPSQKIQLINTNGSWHI
NRTALNCNDSLNTGFLAALFYTHKFNASGCPERMASCRSIDKFDQGWGPITYA
```

-continued

```
EPHDLDQRPYCWHYAPRPCGIVPASEVCGPVYCFTPSPVWGTTDRFGVPTY
SWGENETDVLLLNNTRPPQGNWFGCTWMNSTGFTKTCGAPPCNIGGVGNNT
LTCPTDCFRKHPEATYARCGSGPWLTPRCLVDYPYRLWHYPCTVNFTIFKVRM
YVGGVEHRLDAACNWTRGERCNLEDRDRSELSPLLLSTTEWQVLPCSFTTLPA
LSTGLIHLHQNIVDVQYLYGVGSAVVSFVIKWEYVLLLFLLLADARICACLWMML
LIAQAEAALENLVVLNAASVAGTHGILPFLVFFCAAVVYIKGRLVPGAAYALYGVW
PLLLLLLALPPRAYAMDREVAASCGGAVFIGLALLTLSPHYKVFLAKLIWWLQYFI
TRTEAHLQVWIPPLNVRGGRDAIILLTCAIHPELIFTITKILLAILGPLMVLQAGITKV
PYFVRAHGLIRACMLVRKVAGGHYVQMALMKLAALTGTYVYDHLTPLRDWAHA
GLRDLAVAVEPVVFSDMETKVITWGADTAACGDIILGLPVSARRGREILLGPADS
LEGQGWRLLAPITAYAQQTRGLLGCIITSLTGRDKNQVEGEVQVVSTATQSFLA
TCINGVCWTVFHGAGSKTLAGPKGPVTQMYTNVDQDLVGWQAPPGARSLTPC
TCGSSDLYLVTRHADVIPVRRRGDSRGSLLSPRPVSYLKGSSGGPLLCPSGHA
VGIFRAAVCTRGVAKAVDFVPVESMETTMRSPVFTDNSSPPAVPQSFQVAHLH
APTGSGKSTRVPAAYAAQGYKVLVLNPSVAATLSFGAYMSKAHGVDPNIRTGV
RTITTGAPITYSTYGKFLADGGCSGGAYDIIICDECHSTDSTSILGIGTVLDQAETA
GARLWLATATPPGSVTVPHPNIEEVALSNIGEIPFYGKAIPIETIKGGRHLIFCHS
KKKCDELAAKLSGLGLNAVAYYRGLDVSVIPTSGDWWATDALMTGYTGDFD
SVIDCNTCVIQTVDFSLDPTFTIETTTVPQDAVSRTQRRGRTGRGRGGIYRFVTP
GERPSGMFDSSVLCECYDAGCAWYELTPAETSVRLRAYLNTPGLPVCQDHLE
FWESVFTGLTHIDAHFLSQTKQAGDNFPPYLVAYQATVCARSQAPPPSWDQMW
KCLTRLKPTLHGPTPLLYRLGAVQNEVILTHPITKYIMACMSADLEIVTSTWVLVG
GVLAALAAYCLTTGCVVIVGRIILSGKPAIIPDREVLYREFDEMEECASHLPYIEQ
GMQLAEQFKQKAIGLLQTATKQAEAAVPVVESKWRALEAFWAKHMWNFISGIQ
YLAGLSTLPGNPAIVSLMAFTASITSPLTTQHTLLFNILGGWVAAQLAPPRAASA
FVGAGIVGAAVGSVGLGKVLVDVLAGYGAGVAGALVAFKIMSGEVPSTEDLVNL
LPAILSPGALWGVVCAAILRRHVGPGEGAVQWMNRLIAFASRGNHVSPTHYVP
ESDAAARVTQILSSLTITQLLRRLHQWINEDCSTPCSGSWLRDVWDWICTVLTD
FKTWLQSKLMPRLPGVPFLSCQRGYRGVWRGDGIMHTTCPCGAQITGHVKNG
SMRIVGPKTCSNTWHGTFPINAHTTGPCTPSPAPNYSRALWRVAAEEYVEVTR
VGDFHYVTGMTTDNIKCPCQVPAPEFFTELDGVRLHRYAPACKPLLRDEVTFQ
VGLNQYPVGSQLPCEPEPDVTVLTSMLTDPSHITAETAKRRLARGSPPSLARSS
ASQLSAPSLKATCTTHHDSPDADLIEANLLWRQEMGGNITRVESENKVVILDSF
DPLRAEEDEREVSVAAEILRKSRKFPPALPIWARPDYNPPLIESWKDPDYVPPL
VHGCPLPPTKAPPIPPPRRKRTVVLTESTVSSALAELATKTFGSSESSAVDSGT
ATAPPDQPSDDGDAGSDVESYSSMPPLEGEPGDPDLNDGSWSTVSEEASED
WCCSMSYSWTGALITPCAAEESKLPINALSNSLLRHHNMVYATTSRSASQRQ
KKVTFDRLQVLDDHYRDVLKEMKAKASTVKAKLLSVEEACKLTPPHSARSKFG
YGAKDVRNLSSKAVNHIHSVWKDLLEDTETPIDTTIMAKSEVFCVQPEKGGRKP
ARLIVYPDLGVRVCEKMALYDVVSTLPQAVMGSSYGFQYSPGQRVEFLVNAW
KSKKCPMGFAYDTRCFDSTVTENDIRVEESIYQCCDLAPEARQAIKSLTERLYIG
```

```
GPLTNSKGQSCGYRRCRASGVLTTSCGNTLTCYLKASAACRAAKLQDCTMLV

CGDDLWICDSAGTQEDAASLRVFTEAMTRYSAPPGDPPKPEYDLELITSCSSN

VSVAHDASGKRVYYLTRDPTTPLARAAWETARHTPVNSWLGNIIMYAPTLWAR

MILMTHFFSILLAQEQLEKALDCQIYGATYSIEPLDLPQIIQRLHGLSAFTLHSYSP

GEINRVAACLRKLGVPPLRVWRHRARSVRARLLSQGGRAATCGKYLFNWAVR

TKLKLTPIPAASRLDLSGWFVAGYSGGDIYHSLSRARPRWFMWCLLLLSVGVGI

YLLPNR

Design22.mosaic2 Amino Acid Sequence
                                                  SEQ ID NO: 24
MSTNPKPQRKTKRNTNRRPQDVKFPGGGQIVGGVYLLPRRGPKLGVRATRKT

SERSQPRGRRQPIPKARRPEGRTWAQPGYPWPLYGNEGMGWAGWLLSPRG

SRPSWGPNDPRRRSRNLGKVIDTLTCGFADLMGYIPLVGAPLGGAARALAHGV

RVLEDSVNYATGNLPGCSFSIFLLALLSCLTVPASAYEVRNASGVYHVTNDCSN

SSIVYEAADVIMHTPGCVPCVREGNSSRCWVALTPTLAARNSSIPTTTIRRHVDL

LVGAAAFCSAMYVGDLCGSVFLVSQLFTFSPRRYETVQDCNCSIYPGHVSGHR

MAWDMMMNWSPTTALVVSQLLRIPQAVVDMVAGAHWGVLAGLAYYSMAGN

WAKVLIVMLLFAGVDGHTHVTGGRVASSTQSLVSWLSQGPSQKIQLVNTNGS

WHINRTALNCNDSLQTGFLAALFYTHRFNSSGCPERMASCRPIDKFAQGWGPI

THVVPNISDQRPYCWHYAPQPCGIVPASQVCGPVYCFTPSPVVVGTTDRSGVP

TYNWGENETDVLILNNTRPPRGNWFGCTWMNGTGFTKTCGGPPCNIGGAGN

NTLICPTDCFRKHPEATYTKCGSGPWLTPRCMVDYPYRLWHYPCTVNFTVFKV

RMYVGGVEHRLNAACNWTRGERCDLEDRDRSELSPLLLSTTEWQILPCSFTTL

PALSTGLIHLHRNIVDVQYLYGIGSAVVSFAIKWEYVVLLFLLLADARVCACLWM

MLLVAQAEAALENLVVLNAASVAGAFIGILSFLVFFCAAVVYIKGKLVPGAAYAFY

GVWPLLLLLMALPARAYAMDREMAASCGGAVFVGLVLLTLSPYYKVFLARLIW

WLQYFITRAEAHLQVWVPPLNVRGGRDAIILLTCAVHPELIFDITKLLLAILGPLMV

LQAGITRVPYFVRAQGLIRACMLVRKAAGGHYVQMAFMKLAALTGTYVYNHLT

PLQDWAHAGLRDLAVAVEPVIFSDMETKIITWGADTAACGDIISGLPVSARRGK

EILLGPADSFGEQGWRLLAPITAYSQQTRGLLGCIVTSLTGRDRNQVEGEVQM

VSTATQSFLATCVNGVCWTVYHGAGSKTLAGPKGPITQMYTNVDQDLVGWPA

PPGARSMTPCTCGSSDLYLVTRHADVIPVRRRGDGRGSLLSPRPISYLKGSSG

GPLLCPSGHWGIFRAAVCTRGVAKAVDFIPVESMETTMRSPVYTDNSSPPAVP

QTFQVAHLHAPTGSGKSTKVPAAYAAQGYKVLVLNPSVAATLGFGAYMSKAHG

IDPNIRTGVRTITTGASITYSTYGKFLADGGCSGGAYDIIMCDECHSTDSTTILGIG

TVLDQAETAGVRLTVLATATPPGSVTVPHSNIEEVALSNTGEIPFYGKAIPIEAIK

GGRHLIFCHSRKKCDELAAKLSALGVNAVAYYRGLDVSVIPASGDWWATDAL

MTGFTGDFDSVIDCNTCVTQTVDFSLDPTFTIDTTTVPQDAVSRSQRRGRTGR

GRRGIYRFVTPGERPSGMFDSWLCECYDAGCAWYELTPAETTVRLRAYLNTP

GLPVCQDHLEFWEGVFTGLTHIDAHFLSQTKQAGENFPYLTAYQATVCARAQA

PPPSWDQMWKCLIRLKPTLHGPTPLLYRLGAVQNEVTLTHPITKFIMACMSADL
```

-continued

EVVTSTWVLVGGVLAALAAYCLTTGSVVIVGRIILSGRPAVIPDREVLYQEFDEM
EECATHLPYIEQGMQLAEQFKQKALGLLQTATKQAEAAAPWESKWRALETFW
AKHMWNFISGVQYLAGLSTLPGNPAIASLMAFTASVTSPLTTQSTLLFNILGGW
VAAQLAPPSAASAFVGAGIAGAAVGSIGLGKVLVDILAGYGAGVAGALVAFKVM
SGEMPSTEDLVNLLPAILSPGALWGVVCAAVLRRHVGPGEGAVQWMNRLIAF
ASRGNHVSPTHYVPESDAAVRVTQILSSLTITQLLKRLHQWINEDCSTPCSGSW
LKDVWDWICTVLSDFKTWLQSKLLPRLPGVPFFSCQRGYKGVWRGDGIMQTT
CPCGAQIAGHVKNGSMRIVGPRTCSNTWHGTFPINAYTTGPCTPSPAPNYSKA
LWRVAAEEYVEVTRVGDFHYVTGMTTDNVKCPCQVPAPEFFTEVDGVRLHRY
APACKPLLREEVTFQVGLNQYLVGSQLPCEPEPDVAVLTSMLTDPSHITAEAAK
RRLARGSPPSLASSSASQLSAPSLKATCTTRHDSPDADLIEANLLWRQEMGGNI
TRVESENKVWLDSFEPLRAEEDEREVSVPAEILRKSRKFPRAMPIWARPDYNP
PLLESWKDPDYVPPWHGCPLPPAKAPPIPPPRRKKTWLTESTVSSALAELAT
KTFGSSGSSAVDSGTATAPPDQASDDGDKGSDVESYSSMPPLEGEPGDPDLS
DGSWSTVSEEAGEDVVCCSMSYTWTGALITPCAAEESKLPINPLSNSLLRHHS
MVYSTTSRSASLRQKKVTFDRLQVLDDHYQDVLKEMKAKASTVKAKLLSIEEAC
KLTPPHSAKSKFGYGAKDVRSLSSKAVNHIRSVWKDLLEDTVTPIDTTIMAKNEV
FCVQPEKGGRKPARLIVFPDLGVRVCEKMALYDWSTLPQAVMGPSYGFQYSP
KQRVEFLVNTWKSKKCPMGFSYDTRCFDSTVTESDIRVEESIYQCCDLAPEAR
QAIRSLTERLYVGGPLTNSKGQNCGYRRCRASGVLTTSCGNTLTCYLKATAAC
RAAKLQDCTMLVNGDDLVVICESAGTQEDAANLRVFTEAMTRYSAPPGDPPQP
EYDLELITSCSSNVSVAHDATGKRVYYLTRDPTTPLARAAWETVRHTPVNSWL
GNIIMYAPTLWARMVLMTHFFSILIAQEQLEKALDCQIYGACYSIEPLDLPQIIERL
HGLSAFSLHSYSPGEINRVASCLRKLGVPPLRAWRHRARSVRAKLLSQGGRAA
VCGKYLFNWAVKTKLKLTPIPAASQLDLSGWFVAGYSGGDIYHSVSRARPRWF
MLCLLLLSVGVGIYLLPNR

Design23.mosaic1 Amino Acid Sequence
                                              SED ID NO: 25
MSTNPKPQRQTKRNTNRRPQDVKFPGGGQIVGGVYLLPRRGPKLGVRATRKT
SERSQPRGRRQPIPKARRPEGRTWAQPGYPWPLYGNEGMGWAGWLLSPRG
SRPSWGPNDPRRRSRNLGKVIDTLTCGFADLMGYIPLVGAPLGGVARALAHGV
RVVEDGVNYATGNLPGCSFSIFLLALLSCLTTPASAYEVRNVSGIYHVTNDCSN
SSIVYEAADVIMHTPGCVPCVREDNSSRCWVALTPTLAARNSSIPTTTIRRHVDL
LVGAAALCSAMYVGDFCGSVFLVSQLFTFSPRQHETVQDCNCSIYPGHVSGHR
MAWDMMMNWSPTTALVVSQLLRIPQAIVDMVAGAHWGVLAGLAYYSMAGNW
AKVLIVMLLFAGVDGHTHVTGGRVASSTQSLVSWLSQGPSQKIQLVNTNGSWH
INRTALNCNDSLQTGFLAALFYTHKFNASGCPERMASCRPIDKFAQGWGPITYA
GSCGLDQRPYCWHYAPQPCGIVPAAQVCGPVYCFTPSPVVGTTDRFGAPTY
NWGENETDVLILNNTRPPQGNWFGCTWMNSTGFTKTCGAPPCNIGGVGNNTL
TCPTDCFRKHPDATYTKCGSGPWLTPRCMVDYPYRLWHYPCTVNFTVFKVRM -continued

YVGGVEHRLNAACNWTRGERCDLEDRDRSELSPLLLSTTEWQILPCAFTTLPA

LSTGLIHLHRNIVDVQYLYGVGSAVVSFAIKWEYILLLFLLLADARVCACLWMML

LIAQAEATLENLVVLNAASVAGTHGILPFLVFFCAAVVYIKGRLVPGAAYALYGVW

PLLLLLLALPPRAYAMDREVAASCGGAVFVGLVLLTLSPYYKVFLARLIWWLQYF

ITRAEAHLQVWVPPLNVRGGRDAIILLMCVVHPELIFDITKLLLAILGPLMVLQAGI

TRVPYFVRAQGLIRACMLVRKVVGGHYVQMAFMKLAALTGTYVYDHLTPLQD

WAHAGLRDLAAAVEPVVFSDMETKIITWGAETAACGDIISGLPVSARRGKEILLG

PADSFGEQGWRLLAPITAYSQQTRGLLGCIITSLTGRDKNQVDGEVQVLSTATQ

SFLATCINGVCWTVYHGAGSKTLAGPKGPITQMYTNVDQDLVGWPAPPGARS

MTPCTCGSSDLYLVTRHADVIPVRRRGDNRGSLLSPRPVSYLKGSSGGPLLCP

SGHVVGIFRAAVCTRGVAKAVDFVPVESMETTMRSPVFTDNSSPPAVPQTFQV

SHLHAPTGSGKSTKVPAAYASQGYKVLVLNPSVAATLGFGAYMSKAYGVDPNI

RTGVRTITTGASITYSTYGKFLADGGCSGGAYDIIICDECHSTDATTILGVGTVLD

QAETAGARLVVLATATPPGSVTVPHSNIEEVALSNTGEIPFYGKAIPIEAIKGGRH

LIFCHSKKKCDELATKLSALGINAVAYYRGLDVSVIPTSGDVVVVATDALMTGFT

GDFDSVIDCNTCWQTVDFSLDPTFTIETTTVPQDAVSRTQRRGRTGRGRRGIY

RFVTPGERPSGMFDSVVLCECYDAGCAWYELTPAETTVRLRAYLNTPGLPVC

QDHLEFWEGVFTGLTHIDAHFLSQTKQAGDNFPYLTAYQATVCARAQAPPPSW

DQMWKCLTRLKPTLHGPTPLLYRLGAVQNEVTLTHPITKYIMTCMSADLEWTS

TWVLVGGVLAALAAYCLTTGCWIVGRIILSGKPAVIPDREALYQEFDEMEECAT

HLPYIEQGMQLAEQFKQKALGLLQTASKQAEAAAPVVESKWRALEAFWAKHM

WNFISGVQYLAGLSTLPGNPAIASLMAFTASVTSPLTTQSTLLFNILGGWVAAQL

APPSAASAFVGAGIAGAAIGSIGLGKVLVDILAGYGAGVAGALVAFKVMSGDMP

STEDLVNLLPAILSPGALWGWCAAILRRHVGPGEGAVQWMNRLIAFASRGNH

VSPTHYVPESDAAARVTQILSSLTITQLLRRLHQWINEDCSTPCSGSWLKDVWD

WICTVLADFKTWLQSKLLPRLPGLPFLSCQRGYKGVWRGDGVMQTTCPCGAQ

ISGHVKNGSMRIVGPRTCSNTWHGTFPINAYTTGPCTPSPAPNYSRALWRVAA

EEYVEITRVGDFHYVTGMTTDNVKCPCQVPAPEFFTEVDGVRLHRYAPACRPL

LREEWFQVGLNQYPVGSQLPCEPEPDVTWTSMLTDPSHITAEAAKRRLARG

SPPSLASSSASQLSALSLKATCTTRHDSPDVDLIEANLLWRQEMGGNITRVESE

NKVVILDSFEPLQAEEDEREVSVAAEILRKSRKFPPAMPVWARPDYNPPLLESW

KDPDYVPPWHGCPLPPTKAPPIPPPRRKKTWLTESTVSSALAELATKTFGSS

GSSAVDSGTATAPPDQASDDGDKGSDVESYSSMPPLEGEPGDPDLSDGSWS

TVSGEAGEDVVCCSMSYTWTGALITPCAAEESKLPINPLSNSLLRHHSMVYSTT

SRSASLRQKKVTFDRLQVLDDHYRDVLKEMKAKASTVKAKLLSIEEACKLTPPH

SAKSKFGYGAKDVRNLSSRAVNHIRSVWEDLLEDTETPIDTTIMAKSEVFCVQP

EKGGRKPARLIVYPDLGVRVCEKMALYDWSTLPQAVMGPSYGFQYSPGQRV

EFLVNAWKSKKCPMGFAYDTRCFDSTVTENDIRTEESIYQCCDLDPEARQAIRS

LTERLYVGGPLTNSKGQNCGYRRCRASGVLTTSCGNTLTCYLKATAACRAAKL

QDCTMLVNGDDLVVICESAGTQEDAANLRVFTEAMTRYSAPPGDLPQPEYDLE

-continued

LITSCSSNVSVAHDAAGKRVYYLTRDPTTPLARAAWETVRHTPVNSWLGNIIMY

APTLWARMVLMTHFFSILIAQEQLEKALDCQIYGACYSIEPLDLPQIIERLHGLSA

FSLHSYSPGEINRVASCLRKLGVPPLRTWRHRARSVRAKLLSQGGRAAICGRY

LFNWAVRTKLKLTPIPAASRLDLSGWFVAGYGGGDIYHSLSRARPRWFMLCLLL

LSVGVGIYLLPNR

Design23.mosaic2 Amino Acid Sequence
SEQ ID NO: 26
MSTNPKPQRKTKRNTNRRPQDVKFPGGGQIVGGVYLLPRRGPRLGVRAPRKT

SERSQPRGRRQPIPKARRPEGRAWAQPGYPWPLYGNEGLGWAGWLLSPRG

SRPSWGPSDPRRRSRNLGKVIDTLTCGFADLMGYIPLVGAPLGGAARALAHGV

RVLEDSVNYATGNLPGCSFSIFLLALLSCLTIPASAYEVRNASGVYHVTNDCSNA

SIVYEAADMIMHTPGCVPCVRENNSSRCWVALTPTLAARNASVPTTTIRRHVDL

LVGTAAFCSAMYVGDLCGSVFLVSQLFTFSPRRHETVQDCNCSIYPGHVTGHR

MAWDMIMNWSPTTALVVSQLLRIPQAVVDMVAGAHWGILAGLAYYSMVGNWA

KVLVVMLLFAGVDGGTHVTGGKVAYTTQGFTSFFSRGPSQKIQLVNTNGSWHI

NRTALNCNDSLNTGFLAALFYTHRFNSSGCPERMASCRSIDKFDQGWGPITYA

EPGSSDQRPYCWHYAPKPCGIVPASQVCGPVYCFTPSPWVGTTDRFGVPTY

SWGENETDVLLLNNTRPPQGNWFGCTWMNGTGFTKTCGGPPCNIGGAGNNT

LICPTDCFRKHPEATYTKCGSGPWLTPRCLVDYPYRLWHYPCTVNFTIFKVRM

YVGGVEHRLEAACNWTRGERCNLEDRDRSELSPLLLSTTEWQILPCSFTTLPA

LSTGLIHLHQNWDVQYLYGIGSAWSFAIKWEYVLLLFLLLADARICACLWMML

LIAQAEAALENLVVINAASVAGAHGFLSFLVFFCAAWYIKGRLVPGAAYAIYGVW

PLFLLLLALPPRAYAMDREMAASCGGAVFVGLALLTLSPHYKVFLAKLIWWLQY

LITRAEALLQVWVPPLNVRGGRDAIILLTCAIHPELIFTITKILLAILGPLMVLQAGIT

KVPYFVRAHGLIRACMLVRKVAGGHYVQMALMKLAALTGTYVYDHLTPLRDWA

HAGLRDLAVAVEPVVFSDMETKVITWGADTAACGDIILGLPVSARRGKEIFLGPA

DSLEGQGWRLLAPITAYAQQTRGLLGCIVTSLTGRDRNQVEGEVQVVSTATQS

FLATCVNGVCWTVYHGAGTKTLAGPKGPIIQMYTNVDQDLVGWQAPPGARSL

TPCTCGSSDLYLVTRHADVIPVRRGDGRGSLLSPRPISYLKGSSGGPLLCPLG

HVVGIFRAAVCTRGVAKAVDFIPVESLETTMRSPVYTDNSSPPAVPQSFQVAHL

HAPTGSGKSTKVPAAYAAQGYKVLVLNPSVAATLGFGAYMSKAHGIDPNIRTG

VRTITTGAPVTYSTYGKFLADGGCSGGAYDIIMCDECHSTDSTTILGIGTVLDQA

ETAGARLVVLATATPPGSVTVPHPNIEEVALSNIGEIPFYGKAIPIETIKGGRHLIF

CHSRKKCDELAAKLSGLGLNAVAYYRGLDVSVIPASGDWWATDALMTGFTG

DFDSVIDCNTCVIQTVDFSLDPTFTIDTTTVPQDAVSRSQRRGRTGRGRMGIYR

FVTPGERPSGMFDSSVLCECYDAGCAWYELTPAETSVRLRAYLNTPGLPVCQ

DHLEFWESVFTGLTHIDAHFLSQTKQAGDNFPYLVAYQATVCARSQAPPPSWD

QMWKCLIRLKPTLHGSTPLLYRLGAVQNEVILTHPITKYIMACMSADLEVATSTW

VLVGGVLAALAAYCLTAGSVVIVGRIILSGKPAIIPDREVLYREFDEMEECASQLP

YIEQGMQLAEQFKQKAIGLLQTATKQAEAAVPWESKWRTLEAFWAKHMWNFI

-continued

SGIQYLAGLSTLPGNPAIVSLMAFTASITSPLTTQHTLLFNILGGWVAAQLAPPRA

ASAFVGAGIAGAAVGSIGLGKVLVDVLAGYGAGVAGALVAFKVMSGEMPSTED

LVNLLPAILSPGALVVGWCAAILRRHVGPGEGAVQWMNRLIAFASRGNHVSPT

HYVPESDAAVRVTQILSSLTITQLLKRLHRWINEDCSTPCAGSWLRDVWDWICT

VLTDFKTWLQSKLLPRLPGVPFFSCQRGYKGVWRGDGIMHTTCPCGAQIAGH

VKNGSMKIVGPKTCSNTWHGTFPINAHTTGPCTPSPAPNYSKALWRVAAEEYV

EVTRVGDFHYVTGMTTDNLKCPCQVPAPEFFTELDGVRLHRYAPACKPLLREE

VTFQVGLNQYLVGSQLPCEPEPDVAVLTSMLTDPSHITAETARRRLARGSPPSL

ASSSASQLSAPSLKATCTTRHDSPDADLIEANLLWRQEMGGNITRVESENKVW

LDSFEPLRAEEDEREVSVPAEILRKSRKFPRAMPIWARPDYNPPLIESWKDPDY

APPWHGCPLPPTKTPPIPPPRRKRTWLTESTVSSALAELATKTFGSSESSAAD

SGTATAPPDQPSDDGDAGSDVESYSSMPPLEGEPGDPDLSDGSWSTVSEEA

GEDVVCCSMSYSWTGALITPCAAEETKLPINALSNSLLRHHNLVYATTSRSAGL

RQKKVTFDRLQVPDDHYRDVLKDMKAKASTVKAKLLSVEEACRLTPPHSARSK

FGYGAKDVRSLSSKAVNHIRSVWKDLLEDTDTPIDTTIMAKNEVFCIQPEKGGR

KPARFIVFPDLGVRVCEKMALYDVVSTLPQAVMGSSYGFQYSPKQRVEFLVNT

WKSKKCPMGFSYDTRCFDSTVTESDIRVEESIYQCCDLAPEARQAIRSLTERLYI

GGPLTNSKGQSCGYRRCRASGVLTTSCGNTLTCYLKAAAACRAAKLRDCTML

VCGDDLVVICESAGTQEDEASLRAFTEAMTRYSAPPGDPPKPEYDLELITSCSS

NVSVAHDASGKRVYYLTRDPATPLARAAWETARSTPVNSWLGNIIMYAPTLWA

RMILMTHFFSILLVQEQLEKALDCQIYGAYYSIEPLDLPQIIERLHGLSAFSLHSYS

PGEINRVAACLRKLGVPPLRVWRHRARSVRARLLSQGGRAATCGKYLFNWAV

RTKLKLTPIPAASQLDLSSWFVAGYSGGDIYHSLSRARPRWFMFCLLLLSVGVG

VYLLPNR

Design23.mosaic3 Amino Acid Sequence
SEQ ID NO: 27
MSTNPKPQRKIKRNTNRRPQDVKFPGGGQIVGGVYLLPRRGPRLGVRATRKTS

ERPQPRGRRQPIPKARQPEGRAWAQPGYPWPLYGNEGCGWAGWLLSPRGS

RPSWGPTDPRRRSRNLGKVIDTLTCGLADLMGYIPLVGGPLGGAARALAHGVR

VLEDGVNYATGNLPGCSFSIFLLALLSCLTVPASAYEVRNVSGVYHVTNDCSNS

SIVYETADMIMHTPGCVPCVREGNSSRCWVALTPTLAARNASVPTTAIRRHVDL

LVGAAAFCSAMYVGDLCGSVFLISQLFTFSPRRYETVQDCNCSLYPGHITGHR

MAWDMMMNWSPTAALVVSQLLRIPQAVVDIVAGAHWGILAGLAYYSMVGNWA

KVLIVLLLFAGVDGNTRVSGGEAAKNTMGFASLFVSGPSQKIQLINTNGSWHIN

RTALNCDDSLHTGFLAALFYAHKFNSSGCSGRMASCRPIDEFAQGWGPITHGV

PDNLDQRPYCWHYAPRPCGIVPASEVCGPVYCFTPSPVWGTTDRSGVPTYT

WGENETDVLLLNNTRPPRGNWFGCTWMNGTGFTKTCGGPPCNIGGVGNDTLI

CPTDCFRKHPEATYAKCGSGPWLTPRCIVDYPYRLWHYPCTVNFSIFKVRMYV

GGVEHRLDAACNWTRGERCDLEDRDRTELSPLLLSTTEWQVLPCSFTTLPALS

TGLIHLHQNIVDVQYLYGIGSVVVSFAIKWEYVVLLFLLLADARFCACLWMMLLV

-continued

AQAEAALENLVVLNAASVAGAHGILSFLVFFCAAVVYIKGKLVPGAAYAFYGVWP

LLLLLMALPPRAYALDREMAASCGGAVFIGLALLTLSPHYKAFLARLIWWLQYLIT

RAEAHLQVWIPPLNVRGGRDAIILLTCAVHPELIFEITKILLAIFGPLMVLQAGLTR

VPYFVRAQGLIRACMLVRKAAGGHYVQMALMRLAALTGTYVYNHLTPLRDWA

HTGLRDLAVAVEPVIFSDMETKIITWGADTAACGDILSGLPVSARRGREILLGPA

DSFEGQGWRLLAPITAYSQQTRGLFGCIITSLTGRDKNQVEGEVQVVSTATQSF

LATCVNGVCWTVFHGAGSKTLAGPKGPVTQMYTNVDQDLVGWQAPSGARSL

TPCTCGSSDLYLVTRHADVIPVRRRGDSRGSLLSPRPISYLKGSSGGPLLCPSG

HAVGIFRAAVCTRGVAKAVDFIPVESMETTMRSPVFTDNSTPPAVPQTFQVAHL

HAPTGSGKSTRVPAAYAAQGYKVLVLNPSVAATLSFGAYMSKAHGVDPNIRTGI

RTITTGAPITYSTYGKFLADGGCSGGAYDIIICDECHSTDSTSILGIGTVLDQAETA

GARLVVLATATPPGSITVPHPNIEEVALPNTGEIPFYGKAIPIEVIKGGRHLIFCHS

KKKCDELAAKLSALGVNAVAYYRGLDVSVIPTSGNWWATDALMTGYTGDFD

SVIDCNTCVTQTVDFSLDPTFTIETTTLPQDAVSRSQRRGRTGRGRGGIYRFVT

PGERPSGMFDSSVLCECYDAGCAVVYELTPAVTSVRLRAYLNTPGLPVCQVHL

EFWESVFTGLTHIDAHFLSQTKQAGENFPYLVAYQATVCARAKAPPPSWDQM

WKCLIRLKPTLHGPTPLLYRLGAVQNEITLTHPITKFIMACMSADLEWTSTWVL

VGGVLAALAAYCLTTGSVVIVGRIILSGRPAVIPDREVLYQEFDEMEECASHLPYI

EQGVQLAEQFKQKALGLLQTATKQAEAAAPMVESKWRALETFWAKHMWNFIS

GIQYLAGLSTLPGNPPIASLMAFTASITSPLTTQNTLLFNILGGWVAAQLAPPSAA

SAFVGAGIVGAAVGSVGLGKVLVDILAGYGAGVAGALVAFKIMSGEVPSTEDLV

NLLPAILSPGALVVGVVCAAVLRRHVGPGEGAVQWMNRLIAFASRGNHVSPTH

YVPESDAAARVTQILSNLTITQLLKRLHQWINEDCSTPCSGSWLRDVWDWICTV

LSDFKTWLQSKLLPRLPGVPFLSCQRGYRGVWRGDGIMQTTCPCGAQITGHV

KNGSMRIVGPKTCSNTWRGSFPINAYTTGPSTPSPAPNYTFALWRVSAEEYVE

VRRLGDFHYVTGMTTDNIKCPCQVPAPEFFTELDGVRLHRYAPACKPLLRDEV

TFQVGLNQYVVGSQLPCEPEPDVTVLTSMLTDPSHITAETAKRRLARGSPPSLA

RSSASQLSAPSLKATCTTHHDSPDADLIEANLLWRQEMGGNITRVESENKVVIL

DSFDPLRAEEDEREISVPAEILRKTRKFPPALPIWARPDYNPPLLESWRDPDYV

PPWHGCPLPPAKAPPVPPPRRKRTWLSESTVSSALAELATKTFGSSESSAVD

SGTATAPPDQPSDNGDTGSDVESYSSMPPLEGEPGDPDFSDGSWSTVSEEAS

EDVVCCSMSYTWTGAMITPCAAEESKLPINALSNSLLRHHNMVYATTSRSASQ

RQKKVTFDRLQVLDNHYQDVLKEMKAKASTVKARLLSVEEACKLTPPHSARSK

FGYGAKDVRNLSSKAVNHIHSVWKDLLEDTETPIDTTVMAKNEVFCVQPEKGG

RKPARLIVFPDLGVRVCEKMALYDWSNLPQAVMGSAYGFQYSPGQRVEFLVN

AWKSKKNPMGFAYDTRCFDSTVTENDIRVEESIYQSCDLAPEARQAIKSLTERL

YIGGPLTNSKGQNCGYRRCRVSGVLTTSCGNTLTCYLKASAACRAAKLQDCTM

LVCGDDLVVICDSAGTQEDAASLRVFTEAMTRYSAPPGDPPQPEYDLELITSCS

SNVSVAHDATGKRVYYLTRDPTTPIARAAWETARHTPVNSWLGNIIMYAPTLWV

RMILMTHFFSILLAQEQLEKALDCQIYGATYSIEPLDLPQIIQRLHGLSAFSLHSYS

PGEINRVASCLRKLGVPPLRAWRHRARSVRAKLLSRGGRAATCGRYLFNWAV

KTKLKLTPIPAASQLDLSGWFVAGYSGGDIYHSVSRARPRWFMWCLLLLSVGV

GIYLLPNR

Design24.mosaic1 Amino Acid Sequence
SEQ ID NO: 28
MSTNPKPQRKTKRNTNRRPQDVKFPGGGQIVGGVYLLPRRGPRLGVRATRKT

SERPQPRGRRQPIPKARQPEGRAWAQPGYPWPLYGNEGLGWAGWLLSPRG

SRPSWGPNDPRRRSRNLGKVIDTLTCGFADLMGYIPLVGAPLGGAARALAHGV

RVLEDSVNYATGNLPGCSFSIFLLALLSCLTVPASAYEVRNVSGVYHVTNDCSN

SSIVYEAADIIMHTPGCVPCVRENNSSRCWVALTPTLAARNASVPTTTIRRHVDL

LVGAAAFCSAMYVGDLCGSIFLVGQLFTLSPRRHWTTQDCNCSIYPGHVTGHR

MAWDMMMNWSPTTALVLSQLLRIPQAVVDMVAGAHWGILAGLAYYSMAGNW

AKVLIVMLLFAGVDGGTHVTGGKVAYTTQGFTSFFSRGPSQKIQLVNTNGSWHI

NRTALNCNDSLNTGFLAALFYTHRFNSSGCPERMASCSPIDAFAQGWGPITYN

ESHSSDQRPYCWHYPPQPCGIVPAAQVCGPVYCFTPSPVWGTTDRFGVPTY

TWGENETDVLLLNNTRPPRGNWFGCTWMNSTGFTKTCGGPPCKIGGVGNNT

LTCPTDCFRKHPEATYTRCGSGPWLTPRCLVHYPYRLWHYPCTVNFTIFKVRM

YVGGVEHRLEAACNWTRGERCNLEDRDRSELSPLLLSTTEWQILPCSYTTLPA

LSTGLIHLHQNTVDVQYLYGIGSVVVSFAIKWEYVLLLFLLLADARVCACLWMML

LIAQAEAALENLVVLNAASLAGAHGILSFLVFFCAAVVYIKGRLVPGAAYAFYGVW

PLFLLLLALPPRAYALDREMAASCGGAVFVGLALLTLSPHYKLFLARLIWWLQYF

ITRAEAHLQVWIPPLNVRGGRDAIILLTCAIHPELIFTITKILLAILGPLMVLQAGITK

VPYFVRAHGLIRACMLVRKVAGGHYVQMALMKLAALTGTYVYDHLTPLRDWAH

TGLRDLAVAVEPVIFSDMETKVITWGADTAACGDIILGLPVSARRGKEIFLGPAD

SLEGQGWRLLAPITAYAQQTRGLLGCIITSLTGRDRNQVEGEVQWSTATQSFL

ATCVNGVCWTVFHGAGSKTLAGAKGPITQMYTNVDQDLVGWQAPSGARSLTP

CTCGSSDLYLVTRHADVIPVRRRGDGRGSLLSPRPVSYLKGSSGGPLLCPLGH

AVGIFRAAVCTRGVAKAVDFIPVESMETTMRSPVYTDNSSPPAVPQSFQVAHL

HAPTGSGKSTKVPAAYAAQGYKVLVLNPSVAATLGFGAYMSKAHGIDPNIRTG

VRTITTGGPITYSTYGKFLADGGCSGGAYDIIICDECHSTDSTTILGIGTVLDQAE

TAGARLVVLATATPPGSITVPHPNIEEVALSNIGEIPFYGKAIPIETIKGGRHLIFCH

SKKKCDELAAKLSGLGLNAVAYYRGLDVSVIPTSGDVVVVATDALMTGYTGNF

DSVIDCNTCVTQTVDFSLDPTFTIETTTLPQDAVSRSQRRGRTGRGRMGIYRFV

TPGERPSGMFDSWLCECYDAGCAWYELTPAETSVRLRAYLNTPGLPVCQDH

LEFWEGVFTGLTHIDAHFLSQTKQAGDNLPYLVAYQATVCARAQAPPPSWDQ

MWKCLTRLKPTLHGPTPLLYRLGAVQNEVTLTHPVTKYIMACMSADLEWTST

WVLVGGVLAALAAYCLTTGCVVIVGRIILSGKPAIIPDREVLYQEFDEMEECASH

LPYIEHGMHLAEQFKQKAIGLLQTATKQAEAAAPVVESKWRTLEAFWAKHMWN

FISGIQYLAGLSTLPGNPAIVSLMAFTASITSPLTTQHTLLFNILGGWVAAQLAPP

SAASAFVGAGIAGAAIGSIGLGKVLVDILAGYGAGVAGALVAFKIMSGEAPSTED

LVNLLPAILSPGALVVGIVCAAILRRHVGPGEGAVQWMNRLIAFASRGNHVSPT

-continued

HYVPESDAAARVTQILSSLTITQLLKRLHQWISEDCSTPCSGSWLRDIWDWICT

VLTDFRTWLQSKLLPRLPGVPFLSCQRGYRGVWRGDGIMHTTCPCGAQISGH

VKNGSMRIVGPRTCSNTWHGTFPINAHTTGPCTPSPAPNYSTALWRVAAEEYV

EVRRVGDFHYVTGMTTDNIKCPCQVPAPEFFTEVDGIRLHRYAPACKPLLREEV

TFQVGLNQYLVGSQLPCEPEPDVSVLTSMLTDPSHITAETARRRLARGSPPSLA

SSSASQLSAPSLRATCTTHSSYNLDSPDVDLIEANLLWRQEMGGNITRVESENK

IVILDSFDPLRAEEDEREVSVPAEILRRSRKFPPAMPIWARPDYNPPLLEPWKDP

DYVPPVVHGCPLPPAKAPPIPPPRRKRTWLSESTVSSALAELATKTFSSSESS

AVDSGTATAPPDQPSDDGDAGSDVESYSSMPPLEGEPGDPDLSDGSWSTVS

EEASEDWCCSMSYTWTGALITPCAAEETKLPINALSNSLLRHHNLVYATTSRS

ASQRQRKVTFDRLQVPDDHYRDVLKEMKAKASTVKAKLLSIEEACKLTPPHSAK

SKYGYGAKDVRSLSSKAVNHIRSVWKDLLEDTETPIDTTVMAKNEVFCVQPEK

GGRKAARLIVFPDLGVRVCEKMALYDVVSTLPQAVMGSAYGFQYSPGQRVEFL

VNAWKSKKSPMGFAYDTRCFDSTVTESDIRTEESIYQCCDLAPEARQVIRSLTE

RLYIGGPLTNSKGQNCGYRRCRASGVLTTSCGNTLTCYLKAAAACRAAKLQDC

TMLVCGDDLVVICESAGTQEDEASLRAFTEAMTRYSAPPGDPPKPEYDLELITS

CSSNVSVAHDATGKRVYYLTRDPTIPLARAAWETAKHTPVNSWLGNIIMYAPTL

WVRMILMTHFFSILLVQEQLEKALDCQIYGAYYSIEPLDLPQIIERLHGLSAFSLH

SYSPGEINRVASCLRKLGVPPLRTWRHRARSVRAKLLSQGGRAAICGRYLFNW

AVRTKLKLTPISAASQLDLSSWFVAGYSGGDIYHSLSRARPRWFMFCLLLLSVG

VGVYLLPNR

Design24.mosaic2 Amino Acid Sequence
                                                  SEQ ID NO: 29
MSTNPKPQRKIKRNTNRRPQDVKFPGGGQIVGGVYLLPRRGPRLGVRAPRKT

SERSQPRGRRQPIPKARRPEGRTWAQPGYPWPLYGNEGCGWAGWLLSPRG

SRPSWGPTDPRRRSRNLGKVIDTLTCGLADLMGYIPLVGAPLGGAAKALAHGV

RVLEDGVNYATGNIPGCSFSIFLLALLSCLTTPASAYEVRNASGAYHVTNDCSN

SSIVYETADMIMHTPGCVPCVREGNSSRCWVALTPTLAARNASIPTTAIRRHVD

LLVGTAAFCSAMYVGDLCGSVFLVSQLFTFSPRRHVTLQDCNCSIYPGHVSGH

RMAWDMIMNWSPTTALVVSQLLRIPQAIVDMVAGAHWGVLVGLAYYSMVGNW

AKVLVVMLLFAGVDGTTHVSGAQAGHATRSFTSLFTLGASQKVQLINTNGSWHI

NRTALNCNDSLQTGFLAALFYTHKFNASGCPERMASCRSIDKFDQGWGPITYA

EPHDLDQRPYCWHYAPRPCGIVPASEVCGPVYCFTPSPVVVGTTDRSGAPTY

RWGENETDVLLLNNTRPPHGNWFGCTWMNSTGFTKTCGGPPCNIGGAGNNT

LTCPTDCFRKHPEATYTRCGSGPWLTPRCMVDYPYRLWHYPCTFNFTIFKIRM

YVGGVEHRLDAACNWTRGERCDLDDRDRSELSPLLLSTTEWQILPCSFTTLPA

LSTGLIHLHQNVVDVQYLYGIGSAVVSFVIKWEYVVLLFLLLADARICACLWMML

LIAQAEAALENLVVLNAASVAGAHGFLSFLVFFCAAWYVKGRLVPGAAYALYGV

WPLLLLLLALPPRAYAMDREMAASCGGAVFIGLALLTLSPYYKVFLAKLIWWLQ

YFITRAEAHLHVWVPPLNVRGGRDAIILLMCAVHPELIFDITKILLAIFGPLMVLQA

-continued

```
GLTRVPYFVRAQGLIRVCMLVRKVAGGHYIQMALMKLAALTGTYVYNHLTPLRD
WAHAGLRDLVVAVEPVVFSDMETKIITWGADTAACGDIILGLPVSARRGREILLG
PADSLEGRGWRLLAPITAYAQQTRGLFGCIITSLTGRDKNQVEGEVQVVSTATQ
SFLATCINGVCWTVYHGAGTKTLAGPKGPVTQMYTNVDQDLVGWQAPPGARS
LSPCTCGSSDLYLVTRHADVIPVRRRGDNRGSLLSPRPVSYLKGSSGGPLLCP
SGHAVGIFRAAVCTRGVAKAVDFVPVESMETTTRSPVFTDNSSPPAVPQTFQV
SHLHAPTGSGKSTKVPAAYATQGYKVLVLNPSVAATLGFGAYMSKAYGTDPNI
RTGVRTITTGAPITYSTYGKFLADGGCSGGAYDIIMCDECHSTDSTSILGIGTVLD
QAETAGARLVVLATATPPGSVTVPHPNIEEIALSNTGEIPFYGKAIPIEAIKGGRH
LIFCHSRKKCDELAAKLSGLGINAVAYYRGLDVSVIPASGNVVVVATDALMTGFT
GDFDSVIDCNTCVVQTVDFSLDPTFTIDTTTVPQDAVSRSQRRGRTGRGRRGIY
RFVTPGERPSGMFDSSVLCECYDAGCAWYELTPAETTVRLRAYLNTPGLPVC
QDHLEFWEGVFTGLTHIDAHFLSQTKQAGENFPYLTAYQATVCARALAPPPSW
DQMWKCLVRLKPTLHGPTPLLYRLGAVQNEVILTHPITKYIMACMSADLEWTS
TWVLVGGVLAALAAYCLTAGSWIVGRIVLSGRPAWPDREVLYREFDEMEECA
SQLPYIEQGMQLAEQFRQKALGLLQTATKQAEAAVPVVESKWRALEAFWAKH
MWNFISGVQYLAGLSTLPGNPAIASLMAFTASITSPLTTQYTLLFNILGGWVAAQ
LAPPSAASAFVGAGIAGAAVGSIGLGKVLVDVLAGYGAGVAGALVAFKVMSGE
VPSTEDLVNLLPAILSPGALVVGWCAAILRRHVGPGEGAVQWMNRLIAFASRG
NHVSPTHYVPESDAAVRVTQILSSLTITQLLRRLHQWINEDCSTPCSGSWLRDV
WDWICTVLTDFKTWLQSKLLPRLPGIPFFSCQRGYRGVWRGDGVMQTTCPCG
AQIAGHVKNGSMKIVGPKTCSNTWHGTFPINAYTTGPCTPSPAPNYTRALWRV
AAEDYVEVTRVGDFHYVTGMTTDNVKCPCQVPAPEFFSEVDGVRLHRYAPAC
RPLLREEVTFQVGLNQYWGSQLPCEPEPDVTVLTSMLTDPSHITAEAAKRRLA
RGSPPSLASSSASQLSAPSLKATCTTRHDSPDADLIEANLLWRQEMGGNITRVE
SENKWILDSFEPLRAEEDEREISVPAEILRKSRKFPRAMPIWARPDYNPPLIES
WKDPDYAPPVVHGCPLPPTKAPPIPPPRRKRTWLTESTVSSALAELATKTFGS
SESSAVDSGTASAPPDQPSDNGDTGSDVESYSSMPPLEGEPGDPDLSDGSW
STVSGEAGEDVVCCSMSYTWTGALITPCAAEENKLPINALSNSLLRHHNMVYAT
TSRSAGLRQKKVTFDRQQVLDDHYRDVLKEIKAKASTVKAKLLSVEEACKLTPP
HSARSKFGYGAKDVRNLSSKAVNHIHSVWKDLLEDTVTPIDTTIMAKNEVFCVQ
PEKGGRKPARFIVFPDLGVRVCEKMALYDVVSTLPQAVMGASYGFQYSPSQR
VEFLVNAWKSKKNPMGFAYDTRCFDSTVTESDIRVEESIYQCCDLAPEARQAIK
SLTERLYIGGPMTNSKGQNCGYRRCRASGVLTTSCGNTITCYLKASAACRAAK
LQDCTMLVNGDDLVVICESAGTQEDAAALRAFTEAMTRYSAPPGDPPRPEYDL
ELITSCSSNVSVAHDASGKRVYYLTRDPTTPLARAAWETARHTPINSWLGNIIMY
APTLWARMVLMTHFFSILIAQEQLEKALDCQIYGACYSIEPLDLPQIIERLHGLSA
FTLHSYSPGEINRVASCLRKLGVPPLRVWRHRARSVRARLLSQGGRAATCGKY
LFNWAVRTKLKLTPIPAASRLDLSGWFVAGYGGGDIYHSLSRARPRWFMLCLLL
LSVGVGVYLLPNR
```

Design24.mosaic3 Amino Acid Sequence
SEQ ID NO: 30

MSTNPKPQRQTKRNTNRRPQDVKFPGGGQIVGGVYLLPRRGPKLGVRATRKT

SERSQPRGRRQPIPKARHPEGRAWAQPGYPWPLYGNEGMGWAGWLLSPRG

SRPNWGPTDPRRRSRNLGKVIDTLTCGFADLMGYIPLVGAPLGGVARALAHGV

RVVEDGVNYATGNLPGCSFSIFLLALLSCLTIPASAHEVRNASGVYHVTNDCSN

SSIVYEAADVIMHTPGCVPCVREDNSSRCWVALTPTLAARNSSVPTTTIRRHVD

LLVGAAAFCSVMYVGDLCGSVFLISQLFTFSPRRYETVQDCNCSLYPGHVSGH

RMAWDMMMNWSPTTALWSQLLRIPQAVMDMVAGAHWGVLAGLAYYSMVG

NWAKVLIVLLLFAGVDGNTRVSGGEAAKNTMGFASLFVSGPSQKIQLINTNGSW

HINRTALNCNDSLHTGFLAALFYAHKFNSSGCPERMASCRPIDEFAQGWGPITH

GVPDNLDQRPYCWHYAPQPCGTIPAAQVCGPVYCFTPSPVVVGTTDRFGAPT

YNWGENETDVLILNNTRPPQGNWFGCTWMNSTGFTKTCGAPPCNIGGVGNNT

LVCPTDCFRKHPEATYTKCGSGPWLTPRCLVDYPYRLWHYPCTVNFSIFKVRM

YVGGVEHRLSAACNWTRGERCNVEDRDRSELSPLLLSTTEWQVLPCSFTTLPA

LSTGLIHLHQNIVDVQYLYGVGSAVVSVAIRWEYVVLLFLLLADARFCACLWMM

LLVAQAEAALENLVVLNAASVAGAFIGILPFLVFFCAAVVYIKGKLVPGAAYAIYGV

WPLLLLLLTLPPRAYAMDREVAASCGGAVFVGLVLLTLSPHYKVFLARLIWWLQ

YLITRAEALLQVWVPPLNVRGGRNAIILLTCWHPELIFEITKTLLAILGPLTVLQV

GLTKVPYFVRAQGLIRACMLVRKAAGGHYVQMAFVKLAALTGTYVYDHLTPLQ

DWAHAGLRDLAVAVEPVVFSAMETKIITWGAETAACGDIISSLPVSARRGRELLL

GPADSFEGQGWRLLAPITAYAQQTRGLLGCIVTSLTGRDKNQVEGEAQWSTA

TQSFLATCINGACWTVFHGAGSKTLAGPKGPIIQMYTNVDQDLVGWAAPPGAR

SLTPCTCGSSDLYLVTRHADVIPVRRRGDSRGSLLSPGPISYLKGSSGGPLLCP

SGHAVGVFRAAVCTRGVAKAVDFVPVESMETTMRSPVFTDNSTPPAVPQTFQ

VAHLHAPTGSGKSTKVPAAYAAQGYKVLVLNPSVAATLGFGAYMSKAHGVDPN

IRTGVRTITTGASITYSTYGKFLADGGCSGGAYDIIMCDECHSTDATTILGVGTVL

DQAETAGARLWLATATPPGSVTVPHSNIEEVALSNTGEIPFYGKAIPLETIKGG

RHLIFCHSRKKCDELAAKLSALGVNAVAYYRGLDVSVIPASGDVWVATDALMT

GYTGDFDSVIDCNTCVTQTVDFSLDPTFTIETTTLPQDAVSRAQRRGRTGRGR

AGIYRFVTPGERPSGMFDSSVLCECYDAGCAWYELTPAETSVRLRAYLNTPGL

PVCQDHLEFWESVFTGLTHIDAHFLSQTKQAGDNFPYLTAYQATVCARSQAPP

PSWDQMWKCLLRLKPTLHGPTPLLYRLGAVQNEITLTHPITKFIMACMSADLEV

VTSTWVLVGGVLAALAAYCLTTGSVVIVGRIILSGRPAVIPDREVLYREFDEMEE

CATHLPYIEQGMQLAEQFKQKALGLLQTASKQAEAAAPVMESKWRALETFWAK

HMWNFISGIQYLAGLSTLPGNPAIASLMAFTASVTSPLTTQSTLLFNILGGWVAA

QLAPPSAASAFVGAGIVGAAVGSIGLGRVLVDILAGYGAGVAGALVAFKVMSGD

MPSTEDLVNLLPAILSPGALWGVVCAAILRRHVGPGEGAVQWMNRLIAFASRG

NHVSPTHYVPESDAAARVTQILSNLTITQLLKRLHQWINEDCSTPCSGSWLRDV

WDWICTVLADFKTWLQSKLLPRLPGVPFFSCQRGYKGIWRGDGIMHTTCSCG

AQITGHVKNGSMRIVGPRTCSNTWHGTFPINAYTTGSCTPSPAPNYSKALWRV

AAEEYVEVTRVGDFHYVTGVTTDNIKCPCQVPAPEFFTELDGVRLHRYAPACK

-continued

PLLRDEVTFQVGLNQYTVGSQLPCEPEPDVTWTSMLTDPSHITAEAARRRLAR

GSPPSLASSSASQLSALSLKATCTTHHGAPDTDLIEANLLWRQEMGGNITRVES

ENKVVVLDSFEPLRAEEDEREPSVPAEILRKTRKFPAAMPVWARPDYNPPLLES

WKNPDYVPPVVHGCPLPPTKTPPIPPPRRKKTWLTESTVSSALAELAVKAFGS

SGSSAADSGTATAPPGQPSDCGDTGSDAESYSSMPPLEGEPGDPDFSDGSW

STVSEEAGEDWCCSMSYTWTGALITPCAAEESKLPINALSNSLLRHHSMVYST

TSRSASQRQKKVTFDRLQVLDDHYQDVLKEMKAKASTVKARLLSVEEACRLTP

PHSARSKFGYGAKDVRNLSGKAVNHIRSVWKDLLEDTDTPIDTTIMAKNEVFCI

QPEKGGRKPARLIVYPDLGVRVCEKMALYDVVSTLPQAVMGPSYGFQYSPGQ

RVEFLVNAWKSKKCPMGFAYDTRCFDSTVTENDIRVEESIYQSCDLAPEARQAI

RSLTERLYIGGPLTNSKGQSCGYRRCRASGVLTTSCGNTLTCYLKASAACRAA

KLRDCTMLVCGDDLWICESAGTQEDAANLRVFTEAMTRYSAPPGDPPQPEYD

LELITSCSSNVSVARDASGKRVYYLTRDPTTPIARAAWETARHTPVNSWLGNIIM

YAPTLWARMILMTHFFSILLAQEQLEKALDCQIYGATYSIEPLDLPQIIQRLHGLS

AFSLHSYSPGEINRVAACLRKLGVPPLRVWRHRARSVRAKLLSRGGRAATCGR

YLFNWAVKTKLKLTPIPAASQLDLSGWFVAGYSGGDIYHSVSRARPRWFMWCL

LLLSVGVGIYLLPNR

Design24.mosaic4 Amino Acid Sequence
                                         SEQ ID NO: 31
MSTNPKPQRRTKRNTNRRPQDVKFPGGGQIVGGVYLLPRRGPRLGVRAIRKT

SERSQPRGRRQPIPKARRPEGRAWAQPGYPWPLYGNEGLGWAGWLLSPRG

SRPSWGPSDPRRRSRNLGKVIDTLTCGFADLMGYIPLVGGPLGGAARALAHGV

RVLEDGVNYATGNMPGCSFSIFLLALLSCLTIPASAYEVRNVSGIYHVTNDCSNA

SIVYEAADMIMHTPGCVPCVRESNFSRCWVALTPTLAARNSSIPTTTIRRHVDLL

VGAAALCSAMYVGDLCGSVLLVSQLFTFSPRRHETVQDCNCSIYPGHLSGHRM

AWDMMMNWSPTAALVVSQLLRIPQAVVDMVVGAHWGVLAGLAYYSMVGNWA

KVLIVMLLFAGVDGHTHVTGGRVASSTQSLVSWLSQGPSQKIQLVNTNGSWHI

NRTALNCNDSLQTGFIAALFYAHRFNASGCPERMASCRPIDKFAQGWGPITHV

VPNISDQRPYCWHYAPQPCGIVPASQVCGPVYCFTPSPVVVGTTDRSGVPTYS

WGENETDVLLLNNTRPPQGNWFGCTWMNGTGFTKTCGGPPCNIGGVGNNTLI

CPTDCFRKHPEATYAKCGSGPWLTPRCIVDYPYRLWHYPCTVNFTVFKVRMY

VGGVEHRLNAACNWTRGERCDLEDRDRSELSPLLLSTTEWQILPCAFTTLPAL

STGLIHLHRNIVDVQYLYGIGSAVVSFAIKWEYILLLFLLLADARVCSCLWMMLL

AQAEATLENLVVLNAASVAGTHGILSLLVFFCAAVVYIKGRLVPGAAYAFYGVWP

LLLLLLALPPRAYAMEREMAASCGGGVFVGLVLLTLSPYYKVFLARLIWWLQYLI

TRAEAHLQVWVPPLNVRGGRDAIILLTCAVHPELIFDITKLLLAILGPLMVLQAGIT

RVPYFVRAQGLLRACMLVRKVAGGHYVQMAFMKLAALTGTYVYDHLTPLRDW

AHVGLRDLAVAVEPVVFSDMETKLITWGADTAACGDIISGLPVSARRGKEILLGP

ADSFGEQGWRLLAPITAYSQQTRGLLGCIITSLTGRDKNQVDGEVQVLSTATQS

FLATCVNGVCWTVYHGAGSKTLAGPKGPITQMYTNVDQDLVGWPAPPGARSM

-continued

```
TPCTCGSSDLYLVTRHADWPVRRRGDSRGSLLSPRPISYLKGSSGGPLLCPS

GHWGIFRAAVCTRGVAKAVDFVPVESLETTMRSPVFTDNSSPPTVPQSYQVA

HLHAPTGSGKSTRVPAAYAAQGYKVLVLNPSVAATLSFGAYMSKAHGTDPNIR

TGVRTITTGSPITYSTYGKFLADGGCSGGAYDIIICDECHSTDSTTVLGIGTVLDQ

AETAGVRLTVLATATPPGSVTVPHPNIEEVALSTTGEIPFYGKAIPIEVIKGGRHLI

FCHSKKKCDELAAKLSSLGLNAVAYYRGLDVSVIPSSGDVVVVATDALMTGYTG

DFDSVIDCNTCVIQTVDFSLDPTFTIETTTVPQDAVSRTQRRGRTGRGRGGIYR

FVTPGERPSGMFDSSVLCECYDAGCAWYELTPAVTSVRLRAYLNTPGLPVCQ

VHLEFWESVFTGLTHIDAHFLSQTKQAGDNFPYLVAYQATVCARAKAPPPSWD

QMWKCLIRLKPTLHGSTPLLYRLGAVQNEVTLTHPITKYIMTCMSADLEVATST

WVLVGGVLAALAAYCLTTGSVVIVGRIILSGKPAVIPDREVLYKEFDEMEECASH

LPYIEQGVQLAEQFKQKALGLLQTATKQAEAAAPWESKWQALEAFWAKHMW

NFISGIQYLAGLSTLPGNPAIASLMAFTASITSPLTTQNTLLFNILGGWVAAQLAP

PSAASAFVGAGIVGAAVGSVGLGKVLVDILAGYGAGVAGALVAFKVMSGEMPS

TEDLVNLLPAILSPGALWGWCAAVLRRHVGPGEGAVQWMNRLIAFASRGNH

VSPTHYVPESDAAARVTQILSGLTITQLLKRLHQWINEDCSTPCSGSWLKDVWD

WICTVLSDFKTWLQSKLLPRLPGLPFLSCQRGYKGVWRGDGIMQTTCPCGAQI

TGHVKNGSMRIVGPKTCSNMWHGTFPINAYTTGPCTPSPAPNYSRALWRVAA

EEYVEITRVGDFHYVTGMTTDNLKCPCQVPAPEFFTEVDGVRLHRYAPVCKPL

LREEVVFQVGLNQYPVGSQLPCEPEPDVAVLTSMLTDPSHITAETAKRRLARG

SPPSLARSSASQLSAPSLKATCTTHHDSPDADLIEANLLWRQAMGGNITRVESE

NKVVILDSFDPLHAEEDEREVSVAAEILRKSRKFPPALPIWARPDYNPPLLESWK

DPDYVPPWHGCPLPPTKAPPVPPPRRKRTIVLTESTVSSALAELATKTFGSSG

SSAVDSGTATAPPDQASDDGDKGSDVESYSSMPPLEGEPGDPDLSDGSWST

VSSDGGTEDWCCSMSYSWTGALITPCAAEESKLPINPLSNSLLRHHNLVYSTT

SRSASLRQKKVTFDRLQVLDDHYRDVLKEMKAKASTVKARLLSIEEACKLTPPH

SAKSKFGYGAKDVRNLSSRAVNHIRSVWEDLLEDTETPIDTTIMAKSEVFCQP

EKGGRKPARLIVFPDLGVRVCEKMALYDWSTLPQAVMGSSYGFQYSPKQRVE

FLVNTWKSKKCPMGFSYDTRCFDSTVTENDIRTEESIYQCCDLAPEARQAIRSL

TERLYVGGPLTNSKGQNCGYRRCRASGVLTTSCGNTLTCYLKATAACRAAKLQ

DCTMLVCGDDLVVICDSAGTQEDAASLRVFTEAMTRYSAPPGDLPQPEYDLELI

TSCSSNVSVAYDASGKRVYYLTRDPSTPLARAAWETVRHTPVNSWLGNIIMYA

PTLWARMILMTHFFSILLAQEQLGKALDCQIYGACYSIEPLDLPLIIQRLHGLSAF

SLHSYSPGEINRVASCLRKLGVPPLRAWRHRARSVRATLLSQGGRAAICGKYL

FNWAVKTKLKLTPIPAASQLDLSNWFVAGYNGGDIYHSLSRARPRWIMWCLLLL

SVGVGIYLLPNR

Design25.mosaic1 Amino Acid Sequence
                                        SEQ ID NO: 32
MSTNPKPQRKTKRNTNRRPQDVKFPGGGQIVGGVYLLPRRGPRLGVRATRKT

SERSQPRGRRQPIPKARRPEGRTWAQPGYPWPLYGNEGMGWAGWLLSPRG
```

-continued

SRPSWGPTDPRRRSRNLGKVIDTLTCGFADLMGYIPLVGAPLGGAARALAHGV

RVLEDGVNYATGNLPGCSFSIFLLALLSCLTIPASAYEVRNVSGVYHVTNDCSN

SSIVYEAADMIMHTPGCVPCVRENNSSRCWVALTPTLAARNASVPTTTIRRHVD

LLVGAAAFCSAMYVGDLCGSVFLVSQLFTFSPRRHETVQDCNCSIYPGHITGHR

MAWDMMMNWSPTTALVVSQLLRIPQAVVDMVAGAHWGVLAGLAYYSMVGN

WAKVLIVMLLFAGVDGHTHVTGGRVASSTQSLVSWLSQGPSQKIQLINTNGSW

HINRTALNCNDSLQTGFLAALFYTHKFNASGCPERMASCRPIDEFAQGWGPITY

AEPGSSDQRPYCWHYAPRPCGIVPASQVCGPVYCFTPSPVVVGTTDRFGVPT

YSWGENETDVLLLNNTRPPQGNWFGCTWMNSTGFTKTCGGPPCNIGGVGNN

TLTCPTDCFRKHPEATYTKCGSGPWLTPRCLVDYPYRLWHYPCTVNFTIFKVR

MYVGGVEHRLNAACNWTRGERCDLEDRDRSELSPLLLSTTEWQILPCSFTTLP

ALSTGLIHLHQNIVDVQYLYGVGSSIASWAIKWEYVVLLFLLLADARVCACLWM

MLLIAQAEAALENLVVLNAASVAGAFIGILSFLVFFCAAVVYIKGRLVPGAAYALYG

VWPLLLLLLALPPRAYAMDREMAASCGGAVFVGLVLLTLSPYYKVFLARLIWWL

QYFITRAEAHLQVWVPPLNVRGGRDAIILLTCAVHPELIFDITKLLLAILGPLMVLQ

AGITRVPYFVRAQGLIRACMLVRKVAGGHYVQMAFMKLAALTGTYVYDHLTPL

RDWAHAGLRDLAVAVEPWFSDMETKIITWGADTAACGDIILGLPVSARRGREIL

LGPADSLEGQGWRLLAPITAYAQQTRGLLGCIITSLTGRDKNQVEGEVQVVSTA

TQSFLATCINGVCWTVYHGAGSKTLAGPKGPITQMYTNVDQDLVGWQAPPGA

RSLTPCTCGSSDLYLVTRHADVIPVRRRGDSRGSLLSPRPISYLKGSSGGPLLC

PSGHAVGIFRAAVCTRGVAKAVDFIPVESMETTMRSPVFTDNSSPPAVPQTFQ

VAHLHAPTGSGKSTKVPAAYAAQGYKVLVLNPSVAATLGFGAYMSKAHGVDPN

IRTGVRTITTGAPITYSTYGKFLADGGCSGGAYDIIICDECHSTDATSILGIGTVLD

QAETAGARLVVLATATPPGSVTVPHPNIEEVALSTTGEIPFYGKAIPIETIKGGRH

LIFCHSKKKCDELAAKLSGLGLNAVAYYRGLDVSVIPTSGDVVVVATDALMTGF

TGDFDSVIDCNTCVTQTVDFSLDPTFTIETTTVPQDAVSRSQRRGRTGRGRRGI

YRFVTPGERPSGMFDSSVLCECYDAGCAWYELTPAETSVRLRAYLNTPGLPVC

QDHLEFWESVFTGLTHIDAHFLSQTKQAGDNFPYLVAYQATVCARAQAPPPSW

DQMWKCLIRLKPTLHGPTPLLYRLGAVQNEVTLTHPITKYIMACMSADLEWTST

WVLVGGVLAALAAYCLTTGSVVIVGRIILSGKPAIIPDREVLYREFDEMEECASHL

PYIEQGMQLAEQFKQKALGLLQTATKQAEAAAPWESKWRALEAFWAKHMWN

FISGIQYLAGLSTLPGNPAIASLMAFTASITSPLTTQHTLLFNILGGWVAAQLAPP

SAASAFVGAGIAGAAVGSIGLGKVLVDILAGYGAGVAGALVAFKIMSGEVPSTE

DLVNLLPAILSPGALWGWCAAILRRHVGPGEGAVQWMNRLIAFASRGNHVSP

THYVPESDAAARVTQILSSLTITQLLKRLHQWINEDCSTPCSGSWLRDVWDWIC

TVLTDFKTWLQSKLLPRLPGVPFFSCQRGYKGVWRGDGIMQTTCPCGAQITGH

VKNGSMRIVGPKTCSNTWHGTFPINAYTTGPCTPSPAPNYSRALWRVAAEEYV

EVTRVGDFHYVTGMTTDNVKCPCQVPAPEFFTEVDGVRLHRYAPACKPLLREE

VTFQVGLNQYLVGSQLPCEPEPDVAVLTSMLTDPSHITAETAKRRLARGSPPSL

ASSSASQLSAPSLKATCTTHHDSPDADLIEANLLWRQEMGGNITRVESENKVVI

-continued

LDSFDPLRAEEDEREVSVPAEILRKSRKFPPALPIWARPDYNPPLLESWKDPDY

VPPWHGCPLPPTKAPPIPPPRRKRTWLTESTVSSALAELATKTFGSSESSAV

DSGTATAPPDQPSDDGDAGSDVESYSSMPPLEGEPGDPDLSDGSWSTVSEE

ASEDVVCCSMSYTWTGALITPCAAEESKLPINALSNSLLRHHNMVYATTSRSAS

QRQKKVTFDRLQVLDDHYRDVLKEMKAKASTVKAKLLSVEEACKLTPPHSARS

KFGYGAKDVRNLSSKAVNHIRSVWKDLLEDTETPIDTTIMAKNEVFCVQPEKGG

RKPARLIVFPDLGVRVCEKMALYDVVSTLPQAVMGSSYGFQYSPGQRVEFLVN

AWKSKKTPMGFSYDTRCFDSTVTESDIRVEESIYQCCDLAPEARQAIRSLTERL

YIGGPLTNSKGQNCGYRRCRASGVLTTSCGNTLTCYLKASAACRAAKLQDCTM

LVCGDDLWICESAGTQEDAASLRVFTEAMTRYSAPPGDPPQPEYDLELITSCS

SNVSVAHDASGKRVYYLTRDPTTPLARAAWETARHTPVNSWLGNIIMYAPTLW

ARMILMTHFFSILLAQEQLEKALDCQIYGACYSIEPLDLPQIIQRLHGLSAFSLHSY

SPGEINRVASCLRKLGVPPLRVWRHRARSVRAKLLSQGGRAATCGKYLFNWA

VRTKLKLTPIPAASQLDLSGWFVAGYSGGDIYHSLSRARPRWFMWCLLLLSVG

VGIYLLPNR

Design26.mosaic1 Amino Acid Sequence Amino Acid Sequence
                                                 SEQ ID NO: 33
MSTNPKPQRKTKRNTNRRPQDVKFPGGGKIVGGVYLLPRRGPRLGVRAPRKT

SERSQPRGRRQPIPKARRPEGRTWAQPGYPWPLYGNEGCGWAGWLLSPRG

SRPSWGPNDPRRRSRNLGKVIDTLTCGLADLMGYIPLVGAPLGGAARALAHGV

RVLEDGVNYATGNLPGCSFSIFLLALLSCLTVPASAYQVRNSTGLYHVTNDCPN

SSIVYEAADAILHTPGCVPCVREGNASRCWVAMTPTVATRDGKLPTTQLRRHID

LLVGSATLCSALYVGDLCGSVFLVGQLFTFSPRRHWTTQDCNCSIYPGHITGHR

MAWDMMMNWSPTTALVVAQLLRIPQAILDMIAGAHWGVLAGIAYFSMVGNWA

KVLVVLLLFAGVDAETHVTGGSAAKDTSGFTSLFRIGARQNIQLINSNGSWHINR

TALNCNDSLQTGFLAALFYTHKFNSSGCPERLASCRPLTDFAQGWGPISYANG

SGPDQRPYCWHYPPKPCGIVPAKSVCGPVYCFTPSPVVVGTTDRSGAPTYNW

GENDTDVFVLNNTRPPLGNWFGCTWMNSSGFTKVCGAPPCVIGGVGNNTLHC

PTDCFRKHPEATYSRCGSGPWITPRCLVHYPYRLWHYPCTINYTIFKVRMYVG

GVEHRLEAACNWTRGERCNLEDRDRSELSPLLLSTTQWQVLPCSFTTLPALST

GLIHLHQNVVDVQYLYGVGSSIASWAIKWEYVVLFLLLADARVCSCLWMMLLI

SQAEAALENLVILNAASLAGTHGLVSFLVFFCFAWYLKGRWVPGAVYALYGMW

PLLLLLLALPQRAYALDTEVAASCGGVVLVGLMALTLSPYYKRYISWCLWWLQY

FLTRVEAQLHVWVPPLNVRGGRDAVILLMCVVHPTLVFDITKLLLAVFGPLWILQ

ASLLKVPYFVRVQGLLRICALARKMAGGHYVQMAIIKLGALTGTYVYNHLTPLRD

WAHNGLRDLAVAVEPVVFSQMETKLITWGADTAACGDIINGLPVSARRGREILL

GPADGMVSKGWRLLAPITAYAQQTRGLLGCIVTSLTGRDKNQVEGEVQIVSTA

AQTFLATCINGVCWTVYHGAGTRTIASPKGPVIQMYTNVDKDLVGWPAPQGAR

SLTPCACGSSDLYLVTRHADVIPVRRRGDGRGSLLSPRPVSYLKGSSGGPLLC

PSGHAVGIFRAAVCTRGVAKAVDFVPVESMETTMRSPVFTDNSSPPAVPQTFQ

-continued

```
VAHLHAPTGSGKSTRVPAAYAAQGYKVLVLNPSVAATLSFGAYMSKAHGVDPN

IRTGVRTITTGAPITYSTYGKFLADGGCSGGAYDIIMCDECHSTDSTTILGIGTVL

DQAETAGARLVVLATATPPGSITVPHPNIEEVALSNTGEIPFYGKAIPIETIKGGR

HLIFCHSRKKCDELAAKLSGLGLNAVAYYRGLDVSVIPASGDVVVVATDALMTG

FTGDFDSVIDCNTCVTQTVDFSLDPTFTIETTTVPQDAVSRSQRRGRTGRGRR

GIYRFVTPGERPSGMFDSSVLCECYDAGCAVVYELTPAETTVRLRAYMNTPGLP

VCQDHLEFWEGVFTGLTHIDAHFLSQTKQSGENLPYLVAYQATVCARAQAPPP

SWDQMWKCLIRLKPTLHGSTPLLYRLGAVQNEITLTHPVTKYIMTCMSADLEW

TSTWVLVGGVLAALAAYCLSTGCVVIVGRIVLSGKPAIIPDREVLYREFDEMEEC

SQHLPYIEQGMMLAEQFKQKALGLLQTASRQAEVIAPAVQTNWQKLEAFWAKH

MWNFISGVQYLAGLSTLPGNPAIASLMAFTAAVTSPLTTSQTLLFNILGGWVAA

QLAAPGAATAFVGAGLAGAAIGSVGLGKVLVDIIAGYGAGVAGALVAFKIMSGE

VPSTEDLVNLLPAILSPGALVVGVVCAAVLRRHVGPGEGAVQWMNRLIAFASR

GNHVSPTHYVPESDAAARVTAILSSLTVTQLLRRLHQWISSECTTPCSGSWLRD

IWDWICEVLSDFKTWLKAKLMPQLPGIPFVSCQRGYRGVWRGDGIMHTRCHC

GAEITGHVKNGTMRIVGPRTCRNMWSGTFPINAYTTGPCTPLPAPNYTFALWR

VSAEEYVEIRQVGDFHYVTGMTTDNLKCPCQVPSPEFFTELDGVRLHRFAPPC

KPLLREEVSFRVGLHEYPVGSQLPCEPEPDVAVLTSMLTDPSHITAEAAGRRLA

RGSPPSVASSSASQLSAPSLKATCTANHDSPDAELIEANLLWRQEMGGNITRV

ESENKVWLDSFDPLVAEEDEREISVPAEILRKSRRFAPALPIWARPDYNPPLLE

TWKKPDYEPPWHGCPLPPPQSPPVPPPRKKRTWLTESTVSTALAELATKSF

GSSSTSGITGDNTTTSSEPAPSGCPPDSDAESYSSMPPLEGEPGDPDLSDGS

WSTVSSGADTEDWCCSMSYSWTGALVTPCAAEEQKLPINALSNSLLRHHNLV

YSTTSRSACQRQKKVTFDRLQVLDSHYQDVLKEVKAAASKVKANLLSVEEACS

LTPPHSAKSKFGYGAKDVRCHARKAVNHINSVWKDLLEDSVTPIDTTIMAKNEV

FCVQPEKGGRKPARLIVYPDLGVRVCEKMALYDVVSKLPLAVMGSSYGFQYSP

GQRVEFLVQAWKSKKTPMGFSYDTRCFDSTVTESDIRTEEAIYQCCDLDPQAR

VAIKSLTERLYVGGPLTNSRGENCGYRRCRASGVLTTSCGNTLTCYIKARAACR

AAGLQDCTMLVCGDDLWICESAGVQEDAASLRAFTEAMTRYSAPPGDPPQPE

YDLELITSCSSNVSVAHDGAGKRVYYLTRDPTIPLARAAWETARHTPVNSWLG

NIIMFAPTLWARMILMTHFFSVLIARDQLEQALDCEIYGACYSIEPLDLPPIIQRLH

GLSAFSLHSYSPGEINRVAACLRKLGVPPLRAWRHRARSVRARLLSRGGRAAI

CGKYLFNWAVRTKLKLTPIAAAGQLDLSGWFTAGYSGGDIYHSVSHARPRWF

WFCLLLLAAGVGIYLLPNR

Design26.mosaic2 Amino Acid Sequence
                                            SEQ ID NO: 34
MSTNPKPQRRTKRNTNRRPQDVKFPGGGQIV -continued

SSIVYEAADMIMHTPGCVPCVRENNSSRCWVALTPTLAARNASVPTTTIRRHVD

LLVGAAAFCSAMYVGDLCGSVFLVSQLFTFSPRRHETVQDCNCSIYPGHVSGH

RMAWDMMMNWSPTAALVVSQLLRIPQAVVDMVAGAHWGVLAGLAYYSMVGN

WAKVLIVMLLFAGVDGHTHVTGGRVASSTQSLVSWLSQGPSQKIQLVNTNGS

WHINRTALNCNDSLNTGFLAALFYTHSFNASGCPERMASCRPIDKFDQGWGPI

TYAEPGSSDQRPYCWHYAPRPCGIVPASQVCGPVYCFTPSPVVVGTTDRFGV

PTYSWGENETDVLLLNNTRPPQGNWFGCTWMNSTGFTKTCGGPPCNIGGVG

NNTLTCPTDCFRKHPEATYTKCGSGPWLTPRCLVDYPYRLWHYPCTVNFTIFK

VRMYVGGVEHRLNAACNWTRGERCDLEDRDRSELSPLLLSTTEWQILPCSFTT

LPALTTGLIHLHQNIVDVQYLYGIGSAVVSFAIKWEYVLLLFLLLADARVCACLWM

MLLIAQAEAALENLVVLNAASVAGAFIGILSFLVFFCAAVVYIKGRLVPGAAYALYG

VWPLLLLLLALPPRAYAMDREMAASCGGAVFVGLALLTLSPHYKVFLARLIWWL

QYFITRAEAHLQVWIPPLNVRGGRDAIILLTCAVHPELIFDITKLLLAILGPLMVLQ

AGITRVPYFVRAQGLIRACMLVRKVAGGHYVQMAFMKLAALTGTYVYDHLTPL

RDWAHAGLRDLAVAVEPWFSDMETKIITWGADTAACGDIILGLPVSARRGKEIL

LGPADSLEGQGWRLLAPITAYSQQTRGLLGCIITSLTGRDKNQVEGEVQVVSTA

TQSFLATCVNGVCWTVYHGAGSKTLAGPKGPITQMYTNVDQDLVGWQAPPGA

RSLTPCTCGSSDLYLVTRHADVIPVRRRGDSRGSLLSPRPISYLKGSSGGPLLC

PAGHAVGIFRAAVCTRGVAKAVDFIPVENLETTMRSPVFTDNSSPPAVPQSFQV

AHLHAPTGSGKSTKVPAAYAAQGYTVLVLNPSVAATLGFGAYMSKAHGIDPNIR

TGVRTITTGSPITYSTYGKFLADGGCSGGAYDIIICDECHSTDATSILGIGTVLDQ

AETAGVRLTVLATATPPGSVTVPHPNIEEVALSTTGEIPFYGKAIPLEVIKGGRHL

IFCHSKKKCDELAAKLVALGINAVAYYRGLDVSVIPTSGDVVVVATDALMTGYTG

DFDSVIDCNTCVTQTVDFSLDPTFTIETTTLPQDAVSRTQRRGRTGRGKPGIYR

FVAPGERPSGMFDSSILCECYDAGCAWYELTPAETSVRLRAYLNTPGLPVCQD

HLEFWESVFTGLTHIDAHFLSQTKQAGDNFPYLVAYQATVCARAQAPPPSWDQ

MWKCLTRLKPTLHGPTPLLYRLGAVQNEVTLTHPITKYIMACMSADLEVVTSTW

VLVGGVLAALAAYCLTTGSVVIVGRIILSGKPAVIPDREVLYQEFDEMEECASHL

PYIEQGMQLAEQFKQKALGLLQTATKQAEAAAPWESKWRALETFWAKHMWN

FISGIQYLAGLSTLPGNPAIASLMAFTASITSPLTTQHTLLFNILGGWVAAQLAPP

SAASAFVGAGIAGAAVGSIGLGKVLVDILAGYGAGVAGALVAFKVMSGEMPSTE

DLVNLLPAILSPGALWGWCAAILRRHVGPGEGAVQWMNRLIAFASRGNHVSP

THYVQESDAAARVTQILSSLTITQLLKRLHQWINEDCSTPCSGSWLRDVWDWIC

TVLTDFKTWLQSKLLPRLPGVPFFSCQRGYKGVWRGDGIMQTTCPCGAQITGH

VKNGSMRIVGPKTCSNTWHGTFPINAYTTGPCTPSPAPNYSRALWRVAAEEYV

EVTRVGDFHYVTGMTTDNVKCPCQVPAPEFFTEVDGVRLHRYAPACKPLLREE

VTFQVGLNQYLVGSQLPCEPEPDVTVLTSMLTDPSHITAETAKRRLARGSPPSL

ASSSASQLSAPSLKATCTTHHDSPDADLIEANLLWRQEMGGNITRVESENKVVI

LDSFDPLRAEEDEREVSVPAEILRKSRKFPPALPVWARPDYNPPLLESWKDPD

YVPPVVHGCPLPPTKAPPIPPPRRKRTVVLTESTVSSALAELATKTFGSSESSAV

DSGTATAPPDQPSDDGDAGSDVESYSSMPPLEGEPGDPDLSDGSWSTVSEE

```
ASEDVVCCSMSYTWTGALITPCAAEESKLPINALSNSLLRHHNMVYATTSRSAS

QRQKKVTFDRLQVLDDHYRDVLKEMKAKASTVKAKLLSVEEACKLTPPHSARS

KFGYGAKDVRNLSSKAVNHIRSVWKDLLEDTETPIDTTIMAKSEVFCVQPEKGG

RKPARLIVFPDLGVRVCEKMALYDWSTLPQAVMGSSYGFQYSPKQRVEFLVN

AWKSKKCPMGFAYDTRCFDSTVTENDIRVEESIYQCCDLAPEARQAIRSLTERL

YIGGPLTNSKGQNCGYRRCRASGVLTTSCGNTLTCYLKASAACRAAKLQDCTM

LVNGDDLWICESAGTQEDAASLRVFTEAMTRYSAPPGDPPKPEYDLELITSCS

SNVSVAHDASGKRVYYLTRDPTTPLARAAWETARHTPINSWLGNIIMYAPTLWA

RMILMTHFFSILLAQEQLEKALDCQIYGACYSIEPLDLPQIIERLHGLSAFSLHSYS

PGEINRVASCLRKLGVPPLRVWRHRARSVRAKLLSQGGRAATCGKYLFNWAV

KTKLKLTPIPAASQLDLSGWFVAGYSGGDIYHSLSRARPRWFMWCLLLLSVGV

GIYLLPNR

Design27.mosaic1 Amino Acid Sequence
                                          SEQ ID NO: 35
MSTNPKPQRQTKRNTNRRPQDVKFPGGGQIVGGVYLLPRRGPRLGVRAPRKT

SERSQPRGRRQPIPKARRPEGRTWAQPGYPWPLYGNEGMGWAGWLLSPRG

SRPSWGPSDPRRRSRNLGKVIDTLTCGFADLMGYIPLVGAPLGGAARVLAHGV

RALEDGVNYATGNLPGCSFSIFLLALLSCLTIPASAYEVRNASGVYHVTNDCSN

SSIVYETADSILHSPGCVPCVREGNSSRCWVALTPTLAARNSSIPTTTIRRHVDL

LVGAAALCSAMYVGDLCGSVFLVSQLFTFSPRRYETVQDCNCSIYPGHVSGHR

MAWDMIMNWSPTTALVVSQLLRIPQAVVDMVAGAHWGVLAGLAYYSMAGNW

AKVLIVMLLFAGVDGHTHVTGGRVASSTQSLVSWLSQGPSQKIQLVNTNGSWH

INRTALNCNDSLQTGFIAALFYTHRFNSSGCPERMASCRSIDKFDQGWGPITYA

EPSNSDQRPYCWHYAPQPCGIVPASEVCGPVYCFTPSPWVGTTDRFGVPTY

SWGENETDVLLLNNTRPPQGNWFGCTWMNSTGFTKTCGGPPCNIGGAGNNT

LICPTDCFRKHPEATYTRCGSGPWLTPRCMVDYPYRLWHYPCTVNFTVFKVR

MYVGGVEHRLNAACNWTRGERCDLEDRDRSELSPLLLSTTEWQILPCSFTTLP

ALTTGLIHLHQNIVDVQYLYGVGSSIASWAIKWEYVILLFLLLADARICSCLWMML

LISQAEAALENLVLLNAASLAGTHGLVSFLVFFCAAWYIKGRLVPGAAYALYGV

WPLLLLLLTLPPRAYAMDREMAASCGGAVFVGLVLLTLSPHYKVFLARLIWWLQ

YFITRAEAHLQVWIPPLNVRGGRDAIILLTCAIHPELIFTITKILLAILGPLMVLQAGI

TRVPYFVRAQGLIRACMLVRKVAGGHYVQMAFMKLAALTGTYVYDHLTPLRDW

AHAGLRDLAVAVEPVVFSDMETKIITWGADTAACGDIISGLPVSARRGKEILLGP

ADSFGEQGWRLLAPITAYSQQTRGLFGCIITSLTGRDKNQVDGEVQVLSTATQS

FLATCVNGVCWTVYHGAGSKTLAGPKGPITQMYTNVDQDLVGWPAPPGARSM

TPCTCGSSDLYLVTRHADVIPVRRRGDGRSLLSPRPVSYLKGSSGGPLLCPS

GHWGIFRAAVCTRGVAKAVDFIPVESLETTMRSPVFTDNSSPPAVPQSFQVAH

LHAPTGSGKSTKVPAAYATQGYKVLVLNPSVAATLGFGAYMSKAHGIEPNIRTG

VRTITTGASITYSTYGKFLADGGCSGGAYDIIICDECHSTDSTTILGIGTVLDQAET

AGARLVVLATATPPGSITVPHPNIEEVALSNTGEIPFYGKAIPLEAIKGGRHLIFCH
```

```
SRKKCDELAAKLVALGVNAVAYYRGLDVSVIPTSGDWWATDALMTGFTGDF

DSVIDCNTCVTQTVDFSLDPTFTIETTTLPQDAVSRSQRRGRTGRGRGGIYRFV

TPGERPSGMFDSSVLCESYDAGCAVVYELTPAETTVRLRAYLNTPGLPVCQDHL

EFWESVFTGLTHIDAHFLSQTKQSGENFPYLVAYQATVCARAQALPPSWDQM

WKCLVRLKPTLHGATPLLYRLGAVQNEVTLTHPVTKYIMTCMSADLEWTSTWV

LVGGVLAALAAYCLTTGCVVIVGRVVLSGKPAVVPDREVLYQEFDEMEECASHL

PYIEQGMQLAEQFKQKALGLLQIATKQAEAAAPVVESKWRALETFWAKHMWNF

ISGIQYLAGLSTLPGNPAIASLMAFTAAVTSPLTTSQTLLFNILGGWVAAQLAAPG

AATAFVGAGLAGAAIGSVGLGKVLVDIIAGYGAGVAGALVAFKIMSGEVPSTEDL

VNLLPAILSPGALVVGVVCAAILRRHVGPGEGAVQWMNRLIAFASRGNHVSPTH

YVPESDAAARVTQILSNLTITQLLKRLHQWINEDCSTPCSGSWLKDVWDWICTV

LSDFKTWLQSKLLPRLPGVPFFSCQRGYKGVWRGDGIMQTTCPCGAQIAGHV

KNGSMRIVGPRTCSNTWHGTFPINAYTTGPCTPSPAPNYSRALWRVAAEEYVE

VTRVGDFHYVTGMTTDNVKCPCQVPAPEFFTEVDGVRLHRYAPACKPLLREEV

TFQVGLNQYLVGSQLPCEPEPDVTWTSMLTDPSHITAEAARRRLARGSPPSLA

SSSASQLSAPSLKATCTTRHDSPDADLIEANLLWRQAMGGNITRVESENKVVIL

DSFEPLRAEEDEREVSVAAEILRKSKKFPPALPIWARPDYNPPLLESWKDPDYV

PPWHGCPLPPAKAPPIPPPRRKRTWLTESTVSSALAELATKTFGSSESSAVD

SGTATAPPDQPSDDGDAGSDVESYSSMPPLEGEPGDPDLSDGSWSTVSSEA

GTEDVVCCSMSYTWTGALITPCAAEESKLPINPLSNSLLRHHSMVYSTTSRSAS

LRQKKVTFDRLQVLDDHYRDVLKEMKAKASTVKAKLLSIEEACKLTPPHSAKSK

FGYGAKDVRSLSSRAVNHIRSVWEDLLEDTETPIDTTIMAKSEVFCVQPEKGGR

KPARFIVFPDLGVRVCEKMALYDVVSTLPQAVMGPSYGFQYSPKQRVEFLVNT

WKSKKCPMGFSYDTRCFDSTVTESDIRVEESIYQCCDLAPEARQAIKSLTERLYI

GGPLTNSKGQNCGYRRCRASGVLTTSCGNTLTCYLKATAACRAAKLQDCTML

VNGDDLVVICESQGVQEDAANLRVFTEAMTRYSAPPGDLPQPEYDLELITSCSS

NVSVAHDASGKRVYYLTRDPTTPLARAAWETVRHTPVNSWLGNIIMYAPTLWA

RMVLMTHFFSILIAQEQLEKALDCQIYGACYSIEPLDLPQIIERLHGLSAFTLHSYS

PGEINRVAACLRKLGVPPLRAWRHRARSVRARLLSQGGRAAICGKYLFNWAVK

TKLKLTPIPAASQDLSGWFVAGYSGGDIYHSLSRARPRWFMLCLLLLSVGVGV

YLLPNR

Design27.mosaic2 Amino Acid Sequence
                                                 SEQ ID NO 36
MSTNPKPQRKTKRNTN -continued

AKVLIVLLLFAGVDGNTRVSGGEAAKNTMGFASLFVSGPSQKIQLINTNGSWHI

NSTALNCNDSLNTGFLAALFYTHRFNASGCPERMASCRPIDEFAQGWGPITYT

EPHDLDQRPYCWHYAPRPCGIVPASQVCGPVYCFTPSPVVVGTTDRSGAPTY

NWGENDTDVFVLNNTRPPLGNWFGCTWMNSSGFTKVCGAPPCVIGGVGNNT

LHCPTDCFRKHPEATYSRCGSGPWITPRCLVHYPYRLWHYPCTINYTIFKVRMY

VGGVEHRLDAACNWTRGERCNLDDRDRSELSPLLLSTTQWQVLPCSFATLPA

LSTGLIHLHQNVVDVQYLYGVGSSIVSWAIKWEYVVLLFLLLADARVCSCLWMM

LLISQVEAALENLVILNAASLAGTHGLASFLVFFCFAWYLKGRWVPGAVYALYG

MWPLLLLLLALPQRAYALDTEVAASCGGWLVGLMALTLSPYYKRYISWCLWW

LQYFLTRVEAQLHVWVPPLNVRGGRDAVILLMCWHPTLVFDITKLLLAVFGPL

WILQASLLKVPYFVRVQGLLRICALARKMAGGHYVQMAIIKLGALTGTYVYNHLT

PLRDWAHNGLRDLAVAVEPVVFSQMETKLITWGADTAACGDIINGLPVSARRG

QEILLGPADGMVSKGWRLLAPITAYAQQTRGLLGCIVTSLTGRDKNQVEGEVQI

VSTAAQTFLATCINGVCWTVYHGAGTRTIASPKGPVIQMYTNVDKDLVGWPAP

QGARSLTPCACGSSDLYLVTRHADVIPVRRRGDSRGSLLSPRPISYLKGSSGG

PLLCPAGHAVGIFRAAVCTRGVAKAVDFIPVENLETTMRSPVFTDNSTPPAVPQ

SYQVAHLHAPTGSGKSTKVPAAYAAQGYKVLVLNPSVAATLGFGVYMSKAHGI

DPNIRTGVRTITTGSPITYSTYGKFLADGGCSGGAYDIIICDECHSTDATSILGIGT

VLDQAETAGVRLTVLATATPPGSVTVPHSNIEEVALSTTGEIPFYGKAIPLEVIKG

GRHLIFCHSKKKCDEVAAKLVALGINAVAYYRGLDVSVIPASGDVVVVATDALM

TGFTGDFDSVIDCNTCVTQTVDFSLDPTFTIETITLPQDAVSRTQRRGRTGRGK

PGIYRFVAPGERPSGMFDSSILCECYDAGCAWYELTPAETTVRLRAYMNTPGL

PVCQDHLEFWEGVFTGLTHIDAHFLSQTKQSGENLPYLVAYQATVCARARAPP

PSWDQMWKCLIRLKPTLHGATPLLYRLGAVQNEITLTHPITKYIMACMSADLEVA

TSTWVLVGGVLAALAAYCLTTGSWIVGRIILSGKPAVIPDREVLYQEFDEMEEC

ATHLPYIEQGMQLAEQFRQKALGLLQTATKQAEAAVPVVESKWRALEAFWAKH

MWNFISGIQYLAGLSTLPGNPAIVSLMAFTASVTSPLTTQHTLLFNILGGWVAAQ

LAPPSAASAFVGAGIVGAAVGSVGLGKVLVDILAGYGAGVAGALVAFKVMSGD

MPSTEDLVNLLPAILSPGALWGVVCAAVLRRHVGPGEGAVQWMNRLIAFASR

GNHVSPTHYVPESDAAARVTQILSSLTITQLLKRLHRWINEDCSTPCSGSWLRD

VWDWICTVLTDFKTWLQSKLMPRLPGVPFLSCQRGYKGIWRDGIMHTTCPC

GAQITGHVKNGSMRIVGPKTCSNTWHGTFPINAYTTGPCTPLPAPNYKFALWR

VSAEEYVEIRRVGDFHYVTGMTTDNIKCPCQVPAPEFFTELDGVRLHRYAPACK

PLLRDEVTFQVGLNQYWGSQLPCEPEPDVTVLTSMLTDPSHITAETAKRRLAR

GSPPSMASSSASQLSAPSLKATCTTHHDSPDADLIEANLLWRQEMGGNITRVE

SENKWVLDSFDPLRAEEDEREVSVPAEILRKSRKFPRAMPIWARPDYNPPLIE

SWKDPDYAPPWHGCPLPPTKAPPIPPPRRKRTVVLSESTVSSALAELATKTFG

SSGSSAVDSGTATAPPDQASDDGDKGSDVESYSSMPPLEGEPGDPDLNDGS

WSTVSEEASEDWCCSMSYSWTGALITPCVAEESKLPINALSNSLLRHHNMVY

ATTSRSASQRQKKVTFDRLQVLDNHYQDVLKEMKAKASTVKAKLLSVEEACKL

-continued
TPPHSARSKFGYGAKDVRNLSSKAVNHIRSVWKDLLEDTETPIDTTVMAKNEVF
CVQPEKGGRKPARLIVYPDLGVRVCEKMALYDWSTLPQAVMGSSYGFQYSP
GQRVEFLVNAWKSKKNPMGFAYDTRCFDSTVTENDIRVEESIYQSCDLAPEAR
QAIRSLTERLYIGGPLTNSKGQSCGYRRCRASGVLTTSCGNTLTCYLKASAACR
AAKLRDCTMLVCGDDLWICESAGTQEDAASLRVFTEAMTRYSAPPGDPPKPE
YDLELITSCSSNVSVAHDATGKRVYYLTRDPATPFARAAWETARHTPVNSWLG
NIIMFAPTLWVRMILMTHFFSILLAQEQLEKALDCQIYGATYSIEPLDLPQIIQRLH
GLSAFSLHSYSPGEINRVASCLRKLGVPPLRVWRHRARSVRAKLLSQGGRAAT
CGKYLFNWAVRTKLKLTPIPAASRLDLSGWFVAGYGGGDIYHSVSRARPRWFM
WCLLLLSVGVGIYLLPNR Design27.mosaic3 Amino Acid Sequence
SEQ ID NO: 37
MSTNPKPQRRTKRNTNRRPQDVKFPGGGQIVGGVYLLPRRGPKLGVRATR
KTSERSQPRGRRQPIPKARRPEGRAWAQPGYPWPLYGNEGCGWAGWLLSP
RGSRPSWGPNDPRRRSRNLGKVIDTLTCGLADLMGYIPLVGAPLGGAARA
LAHGVRVLEDGVNYATGNIPGCSFSIFLLALLSCLTVPASAYQVRNSTGL
YHVTNDCPNSSIVYEAADAILHTPGCVPCVREGNASRCWVAMTPTVATRD
GKLPTTQLRRHIDLLVGSATLCSALYVGDLCGSVFLVGQLFTFSPRRHWT
TQDCNCSIYPGHITGHRMAWDMMMNWSPTTALVVAQLLRIPQAILDMIAG
AHWGVLAGIAYFSMVGNWAKVLVVLLLFAGVDAGTHVTGGSAAKDTSGFT
SLFRIGARQNIQLINTNGSWHINRTALNCNASLDTGWVAGLFYYHKFNSS
GCPERLASCRPLADFDQGWGPISYANGSGPEHRPYCWHYPPKPCGIVPAK
SVCGPVYCFTPSPVVVGTTDRFGAPTYNWGENETDVLILNNTRPPQGNWF
GCTWMNGTGFTKTCGAPPCNIGGVGNNTLTCPTDCFRKHPEATYTKCGSG
PWLTPRCLVDYPYRLWHYPCTVNFTIFKVRMYVGGVEHRLEAACNWTRGE
RCNLEDRDRSELSPLLLSTTEWQVLPCSFTTLPALSTGLIHLHRNIVDVQ
YLYGIGSAVVSFAIKWEYVLLLFLLLADARVCACLWMMLLIAQAEAALEN
LVVLNAASVAGAHGILSFLVFFCAAWYIKGKLVPGAAYAFYGVWPLLLLL
LALPPRAYAMDREVAASCGGAVFIGLALLTLSPHYKAFLAKLIWWLQYLI
TRAEAHLQVWVPPLNVRGGRDAIILLTCAVHPELIFDITKLLLAILGPLM
VLQAGLTRVPYFVRAQGLIRMCMLVRKAAGGHYVQMALMKLAALTGTYVY
DHLTPLQDWAHAGLRDLAVAVEPVIFSDMETKVITWGADTAACGDIILGL
PVSARRGREILLGPADSLEGQGWRLLAPITAYSQQTRGLLGCIITSLTGR
DRNQVEGEVQVVSTATQSFLATCINGVCWTVFHGAGSKTLAGPKGPVTQM
YTNVDQDLVGWQAPPGARSLTPCTCGSSDLYLVTRHADVIPVRRRGDNRG
SLLSPRPISYLKGSSGGPLLCPSGHAVGIFRAAVCTRGVAKAVDFVPVES
METTMRSPVYTDNSSPPAVPQTFQVAHLHAPTGSGKSTRVPAAYAAQGYK
VLVLNPSVAATLSFGAYMSKAHGVDPNIRTGVRTITTGAPITYSTYGKFL
ADGGCSGGAYDIIMCDECHSTDSTSILGIGTVLDQAETAGARLTVLATAT
PPGSVTVPHPNIEEVALSNIGEIPFYGKAIPIETIKGGRHLIFCHSKKKC -continued
DELAAKLSGLGLNAVAYYRGLDVSVIPTSGNVVVVATDALMTGYTGDFDS
VIDCNTCVTQSVDFSLDPTFTIETTTVPQDAVSRSQRRGRTGRGRRGIYR
FVTPGERPSGMFDSSVLCECYDAGCAWYELTPAETSVRLRAYLNTPGLPV
CQVHLEFWESVFTGLTHIDAHFLSQTKQAGDNFPYLVAYQATVCARAQAP
PPSWDQMWKCLTRLKPTLHGPTPLLYRLGPVQNEVTLTHPITKFIMACMS
ADLEVVTSTWVLVGGVLAALAAYCLSTGCVVIVGRIVLSGKPAIIPDREV
LYREFDEMEECSQHLPYIEQGMMLAEQFKQKALGLLQTASRQAEVIAPAV
QTNWQKLEAFWAKHMWNFISGVQYLAGLSTLPGNPPIASLMAFTASITSP
LTTQSTLLFNILGGWLAAQLAPPSAASAFVGAGIAGAAVGSIGLGKVLVD
VLAGYGAGVAGALVAFKVMSGEMPSTEDLVNLLPAILSPGALVVGVVCAA
ILRRHVGPGEGAVQWMNRLIAFASRGNHVSPTHYVQESDAAARVTAILSS
LTVTQLLRRLHQWISSECTTPCSGSWLRDIWDWICEVLSDFKTWLKAKLM
PQLPGIPFVSCQRGYRGVWRGDGIMHTRCHCGAEITGHVKNGTMRIVGPR
TCRNMWSGTFPINAYTTGPSTPLPAPNYTFALWRVSAEEYVEIRQVGDFH
YVTGMTTDNLKCPCQVPSPEFFTELDGVRLHRFAPPCKPLLREEVSFRVG
LHEYPVGSQLPCEPEPDVAVLTSMLTDPSHITAEAAGRRLARGSPPSVAS
SSASQLSAPSLKATCTANHDSPDAELIEANLLWRQEMGSNITRVESENKV
VILDSFDPLVAEEDEREISVPAEILRKSRRFAQALPVWARPDYNPPLLET
WKKPDYEPPVVHGCPLPPPQSPPVPPPRKKRTVVLTESTVSTALAELATK
SFGSSSTSGITGDNTTTSSEPAPSGCPPDSDAESYSSMPPLEGEPGDPDF
SDGSWSTVSSGADTEDVVCCSMSYSWTGALVTPCAAEEQKLPINALSNSL
LRHHNLVYSTTSRSACQRQKKVTFDRLQVLDSHYQDVLKEVKAAASKVKA
NLLSVEEACSLTPPHSARSKYGYGAKDVRCHARKAVNHINSVWKDLEDS
VTPIDTTIMAKNEVFCIQPEKGGRKPARLIVFPDLGVRVCEKMALYDVVS
KLPLAVMGSSYGFQYSPGQRVEFLVQAWKSKKTPMGFSYDTRCFDSTVTE
SDIRTEEAIYQCCDLDPQARVAIKSLTERLYVGGPLTNSRGENCGYRRCR
ASGVLTTSCGNTLTCYIKARAACRAAGLQDCTMLVCGDDLVVICESAGVQ
EDAASLRAFTEAMTRYSAPPGDPPQPEYDLELITSCSSNVSVAHDGAGKR
VYYLTRDPTTPLARAAWETARHTPINSWLGNIIMFAPTLWARMILMTHFF

SVLIARDQLEQALDCEIYGACYSIEPLDLPPIIQRLHGLSAFSLHSYSPG

EINRVASCLRKLGVPPLRAWRHRARNVRARLLSRGGRAAICGRYLFNWAV

RTKLKLTPIAAAGQLDLSGWFTAGYSGGDIYHSVSHARPRWFWFCLLLLA

AGVGIYLLPNR

Design28.mosaic1 Amino Acid Sequence
SEQ ID NO: 38

MSTNPKPQRRTKRNTNRRPQDVKFPGGGQIVGGVYLLPRRGPKLGVRATR

KTSERSQPRGRRQPIPKARRPEGRAWAQPGYPWPLYGNEGLGWAGWLLSP

RGSRPSWGPNDPRRRSRNLGKVIDTLTCGFADLMGYIPFVGAPLGGAARA

LAHGVRALEDGVNYATGNLPGCSFSIFLLALLSCLTVPASAYQVRNSTGL

YHVTNDCPNSSIVYEAADAILHTPGCVPCVRENNSSRCWVALTPTLAARN

ASVPTTTIRRHVDLLVGTAAFCSAMYVGDLCGSVLLVSQLFTFSPRRHET

VQDCNCSIYPGHVTGHRMAWDMMMNWSPTTALVVSQLLRIPQAVMDMVAG

AHWGVLAGLAYYSMAGNWAKVLIVMLLFAGVDGGTYVTGGTMAKNTLGIT

SLFSPGSSQKIQLVNTNGSWHINRTALNCNDSLNTGFLAALFYTHKFNAS

GCPERMASCRSIDKFDQGWGPITYAEPHDLDQRPYCWHYAPRPCGIVPAS

EVCGPVYCFTPSPVVVGTTDRFGVPTYSWGENETDVLLLNNTRPPQGNWF

GCTWMNGTGFTKTCGGPPCNIGGVGNNTLICPTDCFRKHPEATYTKCGSG

PWLTPRCLVHYPYRLWHYPCTVNFTIFKVRMYVGGVEHRLEAACNWTRGE

RCNLEDRDRSELSPLLLSTTEWQVLPCSFTTLPALSTGLIHLHQNVVDVQ

YLYGIGSAVVSFAIKWEYVLLLFLLLADARVCACLWMMLLIAQAEAALEN

LVVLNAASVAGAHGILSFLVFFCAAWYIKGKLVPGAAYAFYGVWPLLLLL

MALPARAYAMDREMAASCGGAVFVGLVLLTLSPYYKVFLAKLIWWLQYLI

TRAEAHLQVWIPPLNVRGGRDAIILLTCAIHPELIFTITKILLAILGPLM

VLQAGITKVPYFVRAHGLIRACMLVRKAAGGHYVQMALMKLAALTGTYVY

DHLTPLRDWAHAGLRDLAVAVEPVVFSDMETKVITWGADTAACGDIILGL

PVSARRGKEIFLGPADSLEGQGWRLLAPITAYSQQTRGLLGCIITSLTGR

DRNQVEGEVQVVSTATQSFLATCINGVCWTVFHGAGSKTLAGPKGPVTQM

YTNVDQDLVGWQAPPGARSLTPCTCGSSDLYLVTRHADVIPVRRRGDNRG

SLLSPRPISYLKGSSGGPLLCPSGHAVGIFRAAVCTRGVAKAVDFVPVES

METTMRSPVFTDNSSPPAVPQTFQVAHLHAPTGSGKSTKVPAAYASQGYK

VLVLNPSVAATLSFGAYMSKAHGVDPNIRTGIRTITTGAPITYSTYGKFL

ADGGCSGGAYDIIICDECHSTDSTTILGIGTVLDQAETAGVRLTVLATAT

PPGSVTVPHPNIEEVALSNIGEIPFYGKAIPIETIKGGRHLIFCHSRKKC

DELAAKLSGLGLNAVAYYRGLDVSVIPTSGNVVVVATDALMTGFTGDFDS

VIDCNTCVTQTVDFSLDPTFTIDTTTVPQDAVSRTQRRGRTGRGRRGIYR

FVTPGERPSGMFDSSVLCEECYDAGCAWYELTPSETTVRLRAYMNTPGLPV

CQDHLEFWEGVFTGLTHIDAHFLSQTKQAGDNFPYLVAYQATVCARSQAP

PPSWDQMWKCLLRLKPTLHGATPLLYRLGAVQNEVTLTHPVTKYIMTCMS

ADLEVVTSTWVLVGGVLAALAAYCLSTGCVVIVGRVVLSGKPAIVPDREV

LYQEFDEMEECSQHLPYIEQGMALAEQFKQKALGLLQTASRQAEVITPAV

QTNWQKLEVFWAKHMWNFISGIQYLAGLSTLPGNPPIASLMAFTASITSP

LTTQNTLLFNILGGWVAAQLAAPGAATAFVGAGLAGAAVGSVGLGKVLVD

IIAGYGAGVAGALVAFKIMSGEVPSTEDLVNLLPAILSPGALVVGVVCAA

ILRRHVGPGEGAVQWMNRLIAFASRGNHVSPTHYVPESDAAARVTAILSS

LTVTQLLRRLHQWISSCECTTPCSGSWLRDIWDWICEVLSDFKTWLKAKLM

PQLPGIPFVSCQRGYKGVWRGDGVMHTRCHCGAEITGHVKNGTMRIVGPR

TCRNMWSGTFPINAYTTGPCTPLPAPNYKFALWRVSAEEYVEIRQVGDFH

YVTGMTTDNLKCPCQIPSPEFFTELDGVRLHRYAPPCKPLLREEVSFRVG

LHDYPVGSQLPCEPEPDVTVVTSMLTDPSHITAEAAGRRLARGSPPSVAS

SSASQLSAPSLKATCTTNHDSPDAELIEASLLWRQEMGGNITRVESENKI

VILDSFEPLRAEEDEREVSVAAEILRKTRKFPAAMPVWARPDYNPPLIES

WKDPDYVPPVVHGCPLPPTKAPPIPPPRRKRTVVLTESTVSSALAELATK

TFGSSGSSAVDSGTATGPPDQASAEGDAGSDAESYSSMPPLEGEPGDPDF

SDGSWSTVSEEASEDVVCCSMSYTWTGALITPCAAEETKLPINALSNSLL

RHHNLVYATTSRSASLRQKKVTFDRMQVLDDHYRDVLKEMKAKASTVKAK

LLSVEEACKLTPPHSARSKFGYGAKDVRNLSSKAVNIHHSVWKDLLEDTE

TPIDTTIMAKNEVFCIQPEKGGRKPARLIVYPDLGVRVCEKMALYDVVST

LPQAVMGSSYGFQYSPKQRVEFLVNAWKSKKCPMGFAYDTRCFDSTVTEN

DIRVEESIYQCCDLAPEARQVIRSLTERLYIGGPLTNSKGENCGYRRCRA

SGVLTTSCGNTLTCYIKAQAACRAAGLRDCTMLVCGDDLVVICESAGTQE

DAANLRVFTEAMTRYSAPPGDLPQPEYDLELITSCSSNVSVAHDASGKRV

YYLTRDPTTPLARAAWETVRHTPVNSWLGNIIMFAPTLWARMILMTHFFS

VLIARDQLEQALDCEIYGACYSIEPLDLPPIIQRLHGLSAFSLHSYSPGE

INRVATCLRKLGVPPLRAWRHRARNVRARLLSRGGRAAICGKYLFNWAVR

TKLKLTPIAAAGRLDLSGWFTAGYSGGDIYHSVSHARPRWFWFCLLLLAA

GVGIYLLPNR

Design28.mosaic2 Amino Acid Sequence
SEQ ID NO: 39

MSTNPKPQRKIKRNTNRRPQDVKFPGGGQIVGGVYLLPRRGPRVGVRATR

KTSERSQPRGRRQPIPKARRPEGRSWAQPGYPWPLYGNEGCGWAGWLLSP

RGSRPSWGPSDPRRRSRNLGKVIDTLTCGLADLMGYIPLVGAPLGGAARV

LAHGVRVLEDGVNYATGNLPGCPFSIFLLALLSCLTIPASAYQVRNSSGL

YHVTNDCPNSSIVYETADTILHSPGCVPCVREGNASRCWVAMTPTVATRD

GKLPTTQLRRHIDLLVGSATLCSALYVGDLCGSVFLVGQLFTFSPRRHWT

TQGCNCSIYPGHITGHRMAWDMMMNWSPTAALVMAQLLRIPQAILDMIAG

AHWGVLAGMAYFSMVGNWAKVLVVLLLFAGVDAETHVTGGSAAKDTSGFT

SLFRIGARQNIQLINSNGSWHINRTALNCNASLDTGWVAGLFYYHKFNSS

GCPERMASCRPLADFDQGWGPISYANGSGPEHRPYCWHYPPKPCGIVPAQ

NVCGPVYCFTPSPVVVGTTDKSGAPTYNWGANDTDVFVLNNTRPPLGNWF

-continued

GCTWMNSSGFTKVCGAPPCVIGGVGNNTLHCPTDCFRKHPDATYSRCGSG
PWITPRCLVNYPYRLWHYPCTVNYTLFKVRMYVGGVEHRLEVACNWTRGE
RCDLDDRDRSELSPLLLSTTQWQILPCSFTTLPALTTGLIHLHQNTVDVQ
YLYGVGSSIVSWAIKWEYVILLFLLLADARICSCLWMMLLISQAEAALEN
LVLLNAASLAGTHGLASFLVFFCFAWYLKGKWVPGAAYAFYGMWPLLLLL
LALPQRAYALDTEMAASCGGVVLVGLVALTLSPYYKRYISWCLWWLQYFL
TRVEAHLHVWVPPLNARGGRDAVILLMCVVHPALVFDITKLLLAVFGPLW
ILQTSLLKVPYFVRVQGLLRLCALARKMAGGHYVQMVIIKLGALTGTYIY
NHLTPLRDWAHNGLRDLAVAVEPVVFSQMETKLITWGADTAACGDIINNL
PVSARRGQEILLGPADGMVSKGWRLLAPITAYSQQTRGLLGCIVTSLTGR
DKNQVEGEVQIVSTAAQTFLATCINGVCWTVYHGAGTRTIASSKGPVIQM
YTNVDQDLVGWPAPQGARSLTPCACGSSDLYLVTRHADVIPVRRRGDGRG
SLLSPRPISYLKGSSGGPLLCPAGHAVGIFRAAVCTRGVAKAVDFIPVES
LETTMRSPVFTDNSTPPAVPQSYQVAHLHAPTGSGKSTRVPAAYAAQGYK
VLVLNPSVAATLGFGVYMSKAHGIDPNIRTGVRTITTGAPVTYSTYGKFL
ADGGCSGGAYDIIMCDECHSTDATSILGIGTALDQAETAGARLTVLATAT
PPGSVTVSHPNIEEVALSTTGEIPFYGKAIPLEVIKGGRHLIFCHSKRKC
DELAAKLVALGINAVAYYRGLDVSVIPTSGDVVVVSTDALMTGFTGDFDS
VIDCNTCVIQTVDFSLDPTFTIETITLPQDAVSRTQRRGRTGRGKPGIYR
FVAPGERPSGMFDSVVLCECYDAGCAWYELTPAETSVRLRAYLNTPGLPV
CQDHLEFWEGVFTGLTRIDAHFLSQTKQSGENFPYLVAYQATVCARAQAP
PPSWDQMWKCLTRLKPTLHGPTPLLYRLGAVQNEITLTHPITKYIMTCMA
ADLEVVTSTWVLVGGVLAALTAYCLSTGCVVIVGRIVLSGKPAIIPDREV
LYKEFDEMEECASHLPYIEQGMMLAEQFKQKALGLLQTASRQAEVIAPAV
QTNWQKLEAFWAKHMWNFISGVQYLAGLSTLPGNPAIASLMAFTAAVTSP
LTTSQTLLFNILGGWLAAQLAAPGAATTFVGAGLAGAAIGSVGLGKVLVD
ILAGYGAGVAGALVAFKIMSGEAPSTEDLINLLPAILSPGALVVGIVCAA
ILRRHVGPGEGAVQWMNRLIAFASRGNHVSPTHYVPESDAAARVTTILSS
LTVTQLLRRLHQWISSDCTTPCSGSWLRDVWDWICEVLSDFKTWLKAKLV
PQLPGIPFVSCQRGYRGVWRGDGIMHTRCHCGAEIAGHVKNGTMRIVGPK
TCRNMWSGTFPINAYTTGPCTPLPAPNYTFALWRVSAEEYVEIRRVGDFH

YVTGMTADNLKCPCQVPSPEFFTEVDGVRLHRYAPACKPLLREEVTFQVG

LNQYLVGSQLPCEPELDVTVLTSMLTDPSHITAEAAKRRLARGSPPSEAS

SSASQLSAPSLKATCTTHHDSPDADLIEANLLWRQEMGGNITRVESENKV

VILDSFEPLQAEEDEREVSVAAEILRKSRKFPPALPIWARPDYNPPLLES

WKDPDYVPPVVHGCPLPPPRSPPVPPPRKKRTVVLTESTVSTALAELATK

TFGSSGSSAADSGTATAPPDQASDDGDKGSDVESYSSMPPLEGEPGDPDL

SDGSWSTVSSEAGTEDVVCCSMSYTWTGALITPCVAEESKLPINPLSNSL

LRHHNMIYATTSRSAGLRQKKVTFDRLQVLDDHYRDVLMEVKAKASTVKA

KLLSIEEACKLTPPHSAKSKFGYGAKDVRSLSSRAVNHIRSVWEDLLEDT

ETPIDTTIMAKSEVFCVQPEKGGRKPARFIVFPDLGVRVCEKMALYDVVS

-continued

TLPQAVMGPSYGFQYSPGQRVEFLVNTWKSKKCPMGFSYDTRCFDSTVTE

NDIRTEESIYQCCDLAPEARQAIRSLTERLYVGGPLTNSKGQNCGYRRCR

ASGVLTTSCGNTLTCYLKATAACRAAKLQDCTMLVNGDDLVVICESQGVQ

EDAANLRAFTEAMTRYSAPPGDPPQPEYDLELITSCSSNVSVAHDGAGKR

VYYLTRDPETPLARAAWETARHTPINSWLGNIIMFAPTLWVRMILMTHFF

SILLAQEQLEKALGCQIYGATYFIEPLDLPQIIERLHGLSAFTLHSYSPG

EINRVASCLRKLGVPPLRAWRHRARSVRAKLLSRGGRAATCGKYLFNWAV

KTKLKLTPIAAAGQLDLSGWFTAGYGGGDIYHSVSRARPRWFWFCLLLLT

AGVGIYLLPNR

Design28.mosaic3 Amino Acid Sequence

SEQ ID NO 40

MSTNPKPQRKTKRNTNRRPQDVKFPGGGQIVGGVYLLPRRGPRLGVRAPR

KTSERSQPRGRRQPIPKARRPEGRTWAQPGYPWPLYGNEGMGWAGWLLSP

RGSRPNWGPTDPRRRSRNLGKVIDTLTCGFADLMGYIPLVGGPLGGAARA

LAHGVRVLEDSVNYATGNLPGCSFSIFLLALLSCLTTPASAYEVRNVSGI

YHVTNDCSNASIVYEAADLIMHTPGCVPCVRESNFSRCWVALTPTLAARN

SSIPTTTIRRHVDLLVGAAALCSAMYVGDLCGSVFLVSQLFTFSPRRHWT

TQDCNCSIYPGHVSGHRMAWDMMMNWSPTTALVVAQLLRIPQAIMDMIAG

AHWGVLAGIAYFSMVGNWAKVMVVLLLFAGVDGHTHVTGGRVASSTQSLV

SWLSQGPSQKIQLVNTNGSWHINRTALNCNDSLQTGFLAALFYTHRFNAS

GCPERMASCRPIDKFAQGWGPITHVVPNISDQRPYCWHYAPQPCGIVPAS

QVCGPVYCFTPSPVVVGTTDRFGAPTYNWGENETDVLILNNTRPPQGNWF

GCTWMNSTGFTKTCGGPPCNIGGAGNNTLTCPTDCFRKHPEATYTRCGSG

PWLTPRCLVDYPYRLWHYPCTVNFTVFKVRMYVGGVEHRLNAACNWTRGE

RCDLEDRDRSELSPLLLSTTEWQILPCSFTTLPALSTGLIHLHRNIVDVQ

YLYGVGSAVVSFAIKWEYILLLFLLLADARICACLWMMLLVAQAEAALEN

LVVLNAASVAGTHGILSLLVFFCAAWYIKGRLVPGAAYALYGVWPLLLLL

LALPPRAYAMDREMAASCGGAVFIGLALLTLSPHYKVFLARLIWWLQYFI

TRAEAHLQVWVPPLNVRGGRDAIILLTCAVHPELIFDITKLLLAILGPLM

VLQAGITRVPYFVRAQGLIRACMLVRKVAGGHYVQMAFMKLAALTGTYVY

DHLTPLQDWAHTGLRDLAVAVEPVIFSDMETKIITWGADTAACGDIISGL

PVSARRGKEILLGPADSFGEQGWRLLAPITAYSQQTRGLFGCIITSLTGR

DKNQVDGEVQVLSTATQSFLATCVNGVCWTVYHGAGSKTLAGPKGPITQM

YTNVDQDLVGWPAPPGARSMTPCTCGSSDLYLVTRHADVIPVRRRGDTRG

SLLSPRPVSYLKGSSGGPLLCPSGHVVGIFRAAVCTRGVAKAVDFIPVES

METTMRSPIFTDNSSPPAVPQCYQVAHLHAPTGSGKSTKVPAAYAAQGYK

VLVLNPSVAATLGFGAYMSKAYGVDPNIRTGVRTITTGASITYSTYGKFL

ADGGCSGGAYDIIMCDECHSTDSTSILGIGTVLDQAETAGARLVVLATAT

PPGSITVPHPNIEEVALSNTGEIPFYGKAIPLEAIKGGRHLIFCHSKKKC

DELAAKLVALGVNAVAYYRGLDVSIIPTSGDVVVVATDALMTGYTGDFDS

VIDCNTCVTQSVDFSLDPTFTIETTTLPQDAVSRAQRRGRTGRGRMGIYR
FVTPGERPSGMFDSSILCECYDAGCAWYELTPAETTVRLRAYLNTPGLPV
CQVHLEFWESVFTGLTHIDAHFLSQTKQAGENFPYLTAYQATVCARALAP
PPSWDQMWKCLIRLKPTLHGPTPLLYRLGAVQNEVILTHPITKYIMACMS
ADLEIVTSTWVLVGGVLAALAAYCLTTGCVVIVGRIILSGRPAVIPDREV
LYREFDEMEECASHLPYIEQGMQLAEQFKQKALGLLQTATKQAEAAAPAV
ESKWRALETFWAKHMWNFISGIQYLAGLSTLPGNPAIASLMAFTASVTSP
LTTQSTLLFNILGGWVAAQLAPPSAASAFVGAGIAGAAIGSIGLGKVLVD
ILAGYGAGVAGALVAFKVMSGEMPSTEDLVNLLPAILSPGALVVGVVCAA
VLRRHVGPGEGAVQWMNRLIAFASRGNHVSPTHYVPESDAAARVTQILSS
LTITQLLKRLHRWINEDCSTPCSGSWLKDVWDWICTVLSDFKTWLQSKLL
PRLPGVPFFSCQRGYKGVWRGDGIMQTTCPCGAQITGHVKNGSMRIVGPR
TCSNTWHGTFPINAHTTGPCTPSPAPNYSRALWRVAAEEYVEVTRVGDFH
YVTGMTTDNVKCPCQVPAPEFFTELDGVRLHRFAPPCKPLLRDEVSFRVG
LHEYPVGSQLPCEPEPDVAVLTSMLTDPSHITAEAARRRLARGSPPSMAS
SSASQLSAPSLKATCTANHDSPDAELIEANLLWRQEMGSNITRVESENKV
VVLDSFDPLVAEEDEREISVPAEILRKSRRFAQALPVWARPDYNPPLLET
WKKPDYEPPVVHGCPLPPPQSPPVPPPRKKRTVVLTESTLSTALAELATK
SFGSSSTSGITGDNTTTSSEPAPSGCPPDSDAESCSSMPPLEGEPGDPDL
SDGSWSTVSSGADTEDVVCCSMSYSWTGALVTPCAAEEQKLPINALSNSL
LRHHNLVYSTTSRSACQRQKKVTFDRLQVLDSHYQDVLKEVKAAASKVKA
NLLSVEEACSLTPPHSAKSKFGYGAKDVRCHARKAVNHINSVWKDLLEDS
VTPIDTTIMAKNEIFCVQPEKGGRKAARLIVFPDLGVRVCEKMALYDVVS
KLPLAVMGSSYGFQYSPGQRVEFLVQAWKSKKTPMGFSYDTRCFDSTVTE
SDIRTEEAIYQCCDLDPQARVAIKSLTERLYVGGPLTNSRGENCGYRRCR
VSGVLTTSCGNTLTCYIKARAACRAAGLQDCTMLVCGDDLVVICESAGVQ
EDAASLRAFTEAMTRYSAPPGDPPKPEYDLELITSCSSNVSVAHDDAGKR
VYYLTRDPAIPLARAAWETVRHTPVNSWLGNIIMYAPTLWARMVLMTHFF
SILIAQEQLEKALDCQIYGACYSIEPLDLPLIIQRLHGLSAFSLHSYSPG

EINRVASCLRKLGVPPLRTWRHRARSVRARLLSQGGRAATCGRYLFNWAV

RTKLKLTPIPAASQLDLSGWFVAGYNGGDIYHSLSRARPRWFMLCLLLLS

VGVGIYLLPNR

Design28.mosaic4 Amino Acid Sequence

SEQ ID NO: 41

MSTNPKPQRQTKRNTNRRPQDVKFPGGGQIVGGVYLLPRRGPRLGVRATR

KTSERPQPRGRRQPIPKARQPEGRAWAQPGYPWPLYANEGMGWAGWLLSP

RGSRPSWGPTDPRRRSRNLGRVIDTLTCGFADLMGYIPLVGAPLGGVARA

LAHGVRVVEDGVNYATGNLPGCSFSIFLLALLSCLTIPASAYEVRNVSGV

YHVTNDCSNSSIVYEAADMIMHTPGCVPCVREGNSSRCWVALTPTLAARN

ASIPTTTIRRHVDLLVGAAAFCSAMYVGDLCGSVFLISQLFTFSPRRYET

VQDCNCSLYPGHVSGHRMAWDMMMNWSPTAALVVSQLLRIPQAVVDMVAG

AHWGILAGLAYYSMVGNWAKVLIVLLLFAGVDGNTRVSGGEAAKNTMGFA

SLFVSGPSQKIQLINTNGSWHINSTALNCNESLNTGWLAGLFYHNKFNSS

GCPERLASCRPLTDFAQGWGPISHANGSGPDQRPYCWHYPPRPCGIVPAK

SVCGPVYCFTPSPVVVGTTDRSGAPTYTWGENETDVFVLNNTRPPMGNWF

GCTWMNSTGFTKVCGAPPCAIGGVGNNTLRCPTDCFRKHPEATYSRCGSG

PWITPRCMVDYPYRLWHYPCTINYTIFKVRMYVGGVEHRLDAACNWTRGE

RCNLDDRDRSELSPLLLSTTQWQVLPCSFTPMPALSTGLIHLHQNIVDVQ

YLYGVGSSIASWAIKWEYVVLLFLLLADARVCSCLWMMLLISQVEAALEN

LVILNAASLAGTHGLVSFLVFFCFAWYLKGRWVPGAVYALYGMWPLLLLL

LALPQRAYALDTEVAASCGGVVLVGLMALTLSPYYKHYISWCMWWLQYFL

TRVEAQLHVWVPPLNVRGGRDAVILLTCVVHPTLVFDITKLLLAIFGPLW

ILQASLLKVPYFVRVQGLLRICALARKMVGGHYVQMAIIKLGALTGTYVY

NHLTPLRDWAHNGLQDLAVAVEPVVFSRMETKLITWGADTAACGDIINGL

PVSARRGREILLGPADGMASKGWRLLAPITAYAQQTRGLLGCIVTSLTGR

DKNQAEGEVQIVSTATQTFLATCINGVCWTVYHGAGTRTIASPKGPVIQM

YTNVDKDLVGWPAPQGSRSLTPCTCGASDLYLVTRHADVIPVRRRGDSRG

SLLSPRPISYLKGSSGGPLLCPAGHAVGLFRAAVCTRGVAKAVDFIPVEN

LETTMRSPVFTDNSSPPAVPQSFQVAHLHAPTGSGKSTKVPAAYAAQGYT

VLVLNPSVAATLAFGAYMSKAHGIDPNVRTGVRTITTGSPITYSTYGKFL

ADGGCPGGAYDIIICDECHSTDATTILGVGTVLDQAETAGARLVVLATAT

PPGSVTVPHSNIEEVALSNVGEIPFYGKAIPIEAIKGGRHLIFCHSKKKC

DELAAKLSALGLNAVAYYRGLDVSVIPASGDVVVVATDALMTGYTGDFDS

VIDCNTCVTQTVDFSLDPTFTIETTTVPQDAVSRSQRRGRTGRGRGGIYR

FVTPGERPSGMFDSSVLCESYDAGCAWYELTPAETSIRLRAYLNTPGLPV

CQDHLEFWESVFTGLTHIDAHFLSQTKQSGENLPYLVAYQATVCARAQAL

PPSWDQMWKCLVRLKPTLHGPTPLLYRLGPVQNEVTLTHPITKFIMACMS

ADLEVVTSTVVVLVGGVLAALAAYCLTTGSVVIVGRIILSGKPAVIPDRE

VLYQEFDEMEECATHLPYIEQGMQLAEQFKQKALGLLQTASKQAEAAAPV

VESKWRALEAFWAKHMWNFISGIQYLAGLSTLPGNPAIVSLMAFTASITS

PLTTQHTLLFNILGGWVAAQLAPPSAASAFVGAGIAGAAVGSIGLGKVLV

DIIAGYGAGVAGALVAFKVMSGDMPSTEDLVNLLPAILSPGALVVGVVCA

AVLRRHVGPGEGAVQWMNRLIAFASRGNHVSPTHYVPESDAAARVTQILS

NLTITQLLKRLHQWINEDCSTPCSGTWLRDVWDWICTVLTDFKTWLQSKL

LPRLPGVPFLSCQRGYKGVWRGDGIMHTTCPCGAQIAGHVKNGSMRIVGP

KTCSNTWHGTFPINAYTTGPCTPSPAPNYSKALWRVAAEEYVEITRVGDF

HYVTGMTTDNIKCPCQVPAPEFFTEVDGVRLHRYAPACKPLLRDEVTFQV

GLNQYVVGSQLPCEPEPDVTVLTSMLTDPSHITAETAKRRLARGSPPSLA

SSSASQLSAPSLKATCTTRHDSPDADLIEANLLWRQAMGGNITRVESENK

VVILDSFDPLRAEEDEREVSVPAEILRRSRKFPPAMPIWARPDYNPPLVE

```
PWKRPDYEPPLVHGCPLPPAKAPPVPPPRRKRTVVLSESTVSSALAELAT
KTFGSSESSAVDSGTATAPPDQPSDDGDAGSDVESYSSMPPLEGEPGDPD
LSDGSWSTVSEEAGEDVVCCSMSYSWTGALITPCAAEESKLPINALSNSL
LRHHNMVYATTSRSASQRQKKVTFDRLQVLDNHYQDVLKEMKAKASTVKA
RLLSVEEACSLTPPHSARSKFGYGAKDVRNLSGKAVNHIRSVWKDLLEDT
DTPIDTTIMAKNEVFCVQPEKGGRKPARLIVFPDLGVRVCEKMALYDVVS
KLPVAVMGSSYGFQYSPGQRVEFLVNAWKSKKNPMGFAYDTRCFDSTVTE
SDIRVEESIYQCCDLAPEARQAIKSLTERLYIGGPLTNSKGQSCGYRRCR
ASGVLTTNCGNTLTCYLKASAACRAAKLRDCTMLVCGDDLVVICESAGTQ
EDAASLRVFTEAMTRYSAPPGDPPRPEYDLELITSCSSNVSVAHDATGKR
VYYLTRDPTTPIARAAWETARHTPVNSWLGNIIMYAPTLWVRMILMTHFF
SILLAQEQLGKALDCQIYGATYSIEPLDLPQIIQRLHGLSAFSLHSYSPG
EINRVAACLRKLGVPPLRVWRHRARSVRAKLLSQGGRAAICGRYLFNWAV
KTKLKLTPIPAASRLDLSGWFVAGYSGGDIYHSLSRARPRWFMWCLLLLS
VGVGIYLLPNR

Design29.mosaic1_serial Amino Acid Sequence
                                          SEQ ID NO: 42
MSTNPKPQRKTKRNTNRRPQDVKFPGGGQIVGGVYLLPRRGPRLGVRATR
KTSERSQPRGRRQPIPKARQPEGRAWAQPGYPWPLYGNEGMGWAGWLLSP
RGSRPSWGPTDPRRRSRNLGKVIDTLTCGFADLMGYIPLVGAPLGGAARA
LAHGVRVLEDGVNYATGNLPGCSFSIFLLALLSCLTIPASAYEVRNVSGV
YHVTNDCSNSSIVYEAADMIMHTPGCVPCVRENNSSRCWVALTPTLAARN
ASVPTTTIRRHVDLLVGAAAFCSAMYVGDLCGSVFLVSQLFTFSPRRHET
VQDCNCSIYPGHVSGHRMAWDMMMNWSPTTALVVSQLLRIPQAVVDMVAG
AHWGVLAGLAYYSMVGNWAKVLIVMLLFAGVDGHTHVTGRVASSTQSLV
SWLSQGPSQKIQLVNTNGSWHINRTALNCNDSLQTGFLAALFYTHKFNAS
GCPERMASCRPIDEFAQGWGPITHDMPESSDQRPYCWHYAPRPCGIVPAS
QVCGPVYCFTPSPVVVGTTDRFGVPTYSWGENETDVLLLNNTRPPQGNWF
GCTWMNSTGFTKTCGGPPCNIGGVGNNTLTCPTDCFRKHPEATYTKCGSG
PWLTPRCLVDYPYRLWHYPCTVNFTIFKVRMYVGGVEHRLNAACNWTRGE
RCDLEDRDRSELSPLLLSTTEWQILPCSFTTLPALSTGLIHLHQNIVDVQ
YLYGIGSAVVSFAIKWEYVLLLFLLLADARVCACLWMMLLIAQAEAALEN
LVVLNAASVAGAHGILSFLVFFCAAWYIKGRLVPGAAYALYGVWPLLLLL
LALPPRAYAMDREMAASCGGAVFVGLALLTLSPHYKVFLARLIWWLQYFI
TRAEAHLQVWIPPLNVRGGRDAIILLTCAVHPELIFDITKLLLAILGPLM
VLQAGITRVPYFVRAQGLIRACMLVRKVAGGHYVQMAFMKLAALTGTYVY
DHLTPLRDWAHAGLRDLAVAVEPVVFSDMETKIITWGADTAACGDIILGL
PVSARRGREILLGPADSLEGQGWRLLAPITAYSQQTRGLLGCIITSLTGR
DKNQVEGEVQVVSTATQSFLATCVNGVCWTVYHGAGSKTLAGPKGPITQM
YTNVDQDLVGWQAPPGARSLTPCTCGSSDLYLVTRHADVIPVRRRGDSRG SLLSPRPVSYLKGSSGGPLLCPSGHAVGIFRAAVCTRGVAKAVDFVPVES
METTMRSPVFTDNSSPPAVPQTFQVAHLHAPTGSGKSTKVPAAYAAQGYK
VLVLNPSVAATLGFGAYMSKAHGVDPNIRTGVRTITTGAPITYSTYGKFL
ADGGCSGGAYDIIICDECHSTDSTTILGIGTVLDQAETAGARLVVLATAT
PPGSVTVPHPNIEEVALSNTGEIPFYGKAIPIETIKGGRHLIFCHSKKKC
DELAAKLSGLGLNAVAYYRGLDVSVIPTSGDVVVVATDALMTGFTGDFDS
VIDCNTCVTQTVDFSLDPTFTIETTTVPQDAVSRSQRRGRTGRGRRGIYR
FVTPGERPSGMFDSSVLCECYDAGCAWYELTPAETSVRLRAYLNTPGLPV
CQDHLEFWESVFTGLTHIDAHFLSQTKQAGDNFPYLVAYQATVCARAQAP
PPSWDQMWKCLIRLKPTLHGPTPLLYRLGAVQNEVTLTHPITKYIMACMS
ADLEVVTSTWVLVGGVLAALAAYCLTTGSVVIVGRIILSGKPAIIPDREV
LYQEFDEMEECASHLPYIEQGMQLAEQFKQKALGLLQTATKQAEAAAPVV
ESKWRALETFWAKHMWNFISGIQYLAGLSTLPGNPAIASLMAFTASITSP
LTTQHTLLFNILGGWVAAQLAPPSAASAFVGAGIAGAAVGSIGLGKVLVD
ILAGYGAGVAGALVAFKVMSGEMPSTEDLVNLLPAILSPGALVVGVVCAA
ILRRHVGPGEGAVQWMNRLIAFASRGNHVSPTHYVPESDAAARVTQILSS
LTITQLLKRLHQWINEDCSTPCSGSWLRDVWDWICTVLTDFKTWLQSKLL
PRLPGVPFFSCQRGYKGVWRGDGIMQTTCPCGAQITGHVKNGSMRIVGPK
TCSNTWHGTFPINAYTTGPCTPSPAPNYSRALWRVAAEEYVEVTRVGDFH
YVTGMTTDNVKCPCQVPAPEFFTEVDGVRLHRYAPACKPLLREEVTFQVG
LNQYLVGSQLPCEPEPDVAVLTSMLTDPSHITAETAKRRLARGSPPSLAS
SSASQLSAPSLKATCTTHHDSPDADLIEANLLWRQEMGGNITRVESENKV
VILDSFDPLRAEEDEREVSVPAEILRKSRKFPRAMPIWARPDYNPPLLES
WKDPDYVPPVVHGCPLPPTKAPPIPPPRRKRTVVLTESTVSSALAELATK
TFGSSESSAVDSGTATAPPDQPSDDGDAGSDVESYSSMPPLEGEPGDPDL
SDGSWSTVSEEASEDVVCCSMSYTWTGALITPCAAEESKLPINALSNSLL
RHHNMVYATTSRSASQRQKKVTFDRLQVLDDHYRDVLKEMKAKASTVKAK
LLSVEEACKLTPPHSARSKFGYGAKDVRNLSSKAVNHIRSVWKDLLEDTE
TPIDTTIMAKNEVFCVQPEKGGRKPARLIVFPDLGVRVCEKMALYDVVST
LPQAVMGSSYGFQYSPGQRVEFLVNAWKSKKCPMGFAYDTRCFDSTVTEN
DIRVEESIYQCCDLAPEARQAIRSLTERLYIGGPLTNSKGQNCGYRRCRA
SGVLTTSCGNTLTCYLKASAACRAAKLQDCTMLVCGDDLVVICESAGTQE
DAASLRVFTEAMTRYSAPPGDPPQPEYDLELITSCSSNVSVAHDASGKRV
YYLTRDPTTPLARAAWETARHTPVNSWLGNIIMYAPTLWARMILMTHFFS
ILLAQEQLEKALDCQIYGACYSIEPLDLPQIIQRLHGLSAFSLHSYSPGE
INRVASCLRKLGVPPLRVWRHRARSVRAKLLSQGGRAATCGKYLFNWAVR
TKLKLTPIPAASQLDLSGWFVAGYSGGDIYHSLSRARPRWFMWCLLLLSV
GVGIYLLPNR
```

Design29.mosaic2_serial Amino Acid Sequence
SEQ ID NO: 43
MSTNPKPQRKTKRNTNRRPQDVKFPGGGQIVGGVYLLPRRGPRLGVRTTR
KTSERSQPRGRRQPIPKARRPEGRTWAQPGYPWPLYGNEGCGWAGWLLSP
RGSRPNWGPTDPRRRSRNLGKVIDTLTCGLADLMGYIPLVGAPLGGAARA
LAHGVRVLEDGVNYATGNLPGCSFSIFLLALLSCLTVPASAYQVRNSTGL
YHVTNDCPNSSIVYEAADAILHTPGCVPCVREGNASRCWVAVTPTVATRD
GKLPTTQLRRHIDLLVGSATLCSALYVGDLCGSVFLVGQLFTFSPRRHWT
TQDCNCSIYPGHITGHRMAWDMMMNWSPTTALVVAQLLRIPQAILDMIAG
AHWGVLAGIAYFSMVGNWAKVLVVLLLFAGVDAGTHVTGGSAAKDTSGFT
SLFRIGARQNIQLINTNGSWHINSTALNCNASLDTGWIAGLFYYHKFNSS
GCPERLASCRPLTDFDQGWGPISYANGSGPDQRPYCWHYPPKPCGIVPAK
SVCGPVYCFTPSPVVVGTTDRSGAPTYSWGENDTDVFVLNNTRPPLGNWF
GCTWMNSSGFTKVCGAPPCVIGGVGNNTLHCPTDCFRKHPEATYSRCGSG
PWITPRCLVNYPYRLWHYPCTINYTIFKVRMYVGGVEHRLEAACNWTRGE
RCDLDDRDRSELSPLLLSTTQWQVLPCSFTTLPALTTGLIHLHQNIVDVQ
YLYGVGSSIASWAIKWEYVVLFLLLADARVCSCLWMMLLISQAEAALEN
LVILNAASLAGTHGLVSFLVFFCFAWYLKGRWVPGAVYALYGMWPLLLLL
LALPQRAYALDTEVAASCGGVVLVGLMALTLSPYYKRYISWCLWWLQYFL
TRVEAQLHVWVPPLNVRGGRDAVILLMCVVHPTLVFDITKLLLAVFGPLW
ILQASLLKVPYFVRVQGLLRICALARKMAGGHYVQMAIIKLGALTGTYVY
NHLTPLRDWAHNGLRDLAVAVEPVVFSQMETKLITWGADTAACGDIINGL
PVSARRGQEILLGPADGMVSKGWRLLAPITAYAQQTRGLLGCIVTSLTGR
DKNQVEGEVQIVSTAAQTFLATCINGVCWTVYHGAGTRTIASPKGPVIQM
YTNVDKDLVGWPAPQGARSLTPCTCGSSDLYLVTRHADVIPVRRRGDGRG
SLLSPRPISYLKGSSGGPLLCPAGHAVGIFRAAVCTRGVAKAVDFIPVEN
LETTMRSPVFTDNSSPPAVPQSFQVAHLHAPTGSGKSTKVPAAYAAQGYT
VLVLNPSVAATLGFAYMSKAHGIDPNIRTGVRTITTGSPITYSTYGKFL
ADGGCSGGAYDIIICDECHSTDATSILGIGTVLDQAETAGARLTVLATAT
PPGSITVPHPNIEEVALSTTGEIPFYGKAIPLEVIKGGRHLIFCHSKRKC
DELAAKLVALGINAVAYYRGLDVSVIPASGDVVVVATDALMTGYTGDFDS
VIDCNTCVTQTVDFSLDPTFTIETTTLPQDAVSRTQRRGRTGRGKPGIYR
FVAPGERPSGMFDSSILCECYDAGCAWYELTPAETTVRLRAYMNTPGLPV
CQDHLEFWEGVFTGLTHIDAHFLSQTKQSGENLPYLVAYQATVCARAQAL
PPSWDQMWKCLTRLKPTLHGPTPLLYRLGAVQNEITLTHPVTKYIMTCMS
ADLEVVTSTWVLVGGVLAALAAYCLSTGCVVIVGRIVLSGKPAIIPDREV
LYREFDEMEECSQHLPYIEQGMMLAEQFKQKALGLLQTASRQAEVIAPAV
QTNWQKLEAFWAKHMWNFISGIQYLAGLSTLPGNPAIASLMAFTAAVTSP
LTTSQTLLFNILGGWVAAQLAAPGAATAFVGAGLAGAAIGSVGLGKVLVD
IIAGYGAGVAGALVAFKIMSGEVPSTEDLVNLLPAILSPGALVVGVVCAA
ILRRHVGPGEGAVQWMNRLIAFASRGNHVSPTHYVQESDAAARVTAILSS
LTVTQLLRRLHQWISSECTTPCSGSWLRDIWDWICEVLSDFKTWLKAKLM PQLPGIPFVSCQRGYRGVWRGDGIMHTRCHCGAEITGHVKNGTMRIVGPR
TCRNMWSGTFPINAYTTGPCTPLPAPNYTFALWRVSAEEYVEIRQVGDFH
YVTGMTTDNLKCPCQVPSPEFFTELDGVRLHRFAPPCKPLLREEVSFRVG
LHEYPVGSQLPCEPEPDVAVLTSMLTDPSHITAEAAGRRLARGSPPSVAS
SSASQLSAPSLKATCTANHDSPDAELIEANLLWRQEMGGNITRVESENKV
VVLDSFDPLVAEEDEREISVPAEILRKSRRFAPALPIWARPDYNPPLLET
WKKPDYEPPVVHGCPLPPPQSPPVPPPRKKRTVVLTESTVSTALAELATK
SFGSSSTSGITGDNTTTSSEPAPSGCPPDSDAESYSSMPPLEGEPGDPDL
SDGSWSTVSSGADTEDVVCCSMSYSWTGALVTPCAAEEQKLPINALSNSL
LRHHNLVYSTTSRSACQRQKKVTFDRLQVLDSHYQDVLKEVKAAASKVKA
NLLSVEEACSLTPPHSAKSKFGYGAKDVRCHARKAVNHINSVWKDLLEDS
VTPIDTTIMAKNEVFCVQPEKGGRKPARLIVYPDLGVRVCEKMALYDVVS
KLPLAVMGSSYGFQYSPGQRVEFLVQAWKSKKTPMGFSYDTRCFDSTVTE
SDIRTEEAIYQCCDLDPQARVAIKSLTERLYVGGPLTNSRGENCGYRRCR
ASGVLTTSCGNTLTCYIKARAACRAAGLQDCTMLVCGDDLVVICESAGVQ
EDAASLRAFTEAMTRYSAPPGDPPQPEYDLELITSCSSNVSVAHDGAGKR
VYYLTRDPTTPLARAAWETARHTPINSWLGNIIMFAPTLWARMILMTHFF
SVLIARDQLEQALDCEIYGACYSIEPLDLPPIIQRLHGLSAFSLHSYSPG
EINRVAACLRKLGVPPLRAWRHRARSVRARLLSRGGRAAICGKYLFNWAV
KTKLKLTPIAAAGQLDLSGWFTAGYSGGDIYHSVSHARPRWFWFCLLLLA
AGVGIYLLPNR Design29.mosaic3_serial Amino Acid Sequence
SEQ ID NO: 44
MSTNPKPQRKTKRNTNRRPQNVKFPGGGQIVGGVCLLPRRGPRVGVRATR
KTSERSQPRGRRQPIPKARRPEGRSWAQPGYPWPLYGNEGCGWAGWLLSP
RGSRPSRGPSDPRRRSRNLGKVIDTLTYGFADLMGYIPLVGAPLGGAARA
LAHGVRVLEDGVNYATGNLPGCSFSIFLLALLSCLTVPASAVGRNSSGV
YHVTNDCPNASVVYETDSLIIHLPGCVPCVREGNGSRCWVSLSPTVAAKD
PGVPVNEIRRHVDLIAGAAAFCSAMYVGHLCGSIFLVGQLFTLSPRRHWT
TQDCNCSIYPGHVTGHRMAWDMMMNWSPTGALVVAQLLRIPQAVLDMIAG
AHWGVLAGPAYYSMVGNWAKVVVVLLLFAGVDATTQVTGGTAGRNAYRLA
SLFSTGPSQNIQLINSNGSWHINRTALNCNDSLHTGWVAALFYSHKFNSS
GRPERMASCRPLTAFDQGWGPITHEGNASDDQRPYCWHYALRPCGIVPAK
KVCGPVYCFTPSPVVVGTTDRAGVPTYRWGANETDVLLLNNSRPPMGNWF
GCTWMNSSGFTKTCGAPACNVGGSETNTLSCPTDCFRRHPDATYAKCGSG
PWLNPRCMVDYPYRLWHYPCTVNYTIFKIRMFVGGVEHRLDAACNWTRGE
RCDLDDRDRAELSPLLLSTTQWQVLPCSFTTLPALSTGLIHLHQNIVDVQ
YLYGLSSAVTSWVIKWEYVVLFLLLADARICACLWMMLLISQVEAALEN
LIVLNAASLVGTHGIVPFFIFFCAAWYLKGKWAPGLAYSVYGMWPLLLLL
LALPQRAYALDQELAASCGATVFICLAVLTLSPYYKQYMARGIWWLQYML -continued TRAEALLQVWVPPLNARGGRDGVVLLTCVLHPHLLFEITKIMLAILGPLW
ILQASLLRVPYFVRAHGLIRLCMLVRKTAGGHYVQMALLKLGALTGTYIY
NHLSPLQDWAHSGLRDLAVATEPVIFSRMEIKTITWGADTAACGDIINGL
PVSARRGREVLLGPADALTDKGWRLLAPITAYAQQTRGLLGCIVTSLTGR
DKNQVEGEIQIVSTATQTFLATCINGACWTVYHGAGSRTIASASGPVVRM
YTNVDQDLVGWPAPQGARSLTPCTCGASDLYLVTRHADVIPVRRGDNRG
SLLSPRPISYLKGSSGGPLLCPMGHAVGIFRAAVCTRGVAKAVDFVPVES
LETTMRSPVFTDNSSPPTVPQSYQVAHLHAPTGSGKSTKVPAAYAAQGYK
VLVLNPSVAATLGFGAYMSKAHGIDPNVRTGVRTITTGSPITHSTYGKFL
ADGGCPGGAYDIIICDECHSVDATSILGIGTVLDQAETAGVRLTVLATAT
PPGLVTVPHSNIEEVALSADGEKPFYGKAIPLNYIKGGRHLIFCHSKKKC
DELAAKLVGLGVNAVAFYRGLDVSVIPTTGDVVVVATDALMTGFTGDFDS
VIDCNTCVVQTVDFSLDPIFSIETSTVPQDAVSRSQRRGRTGRGKHGIYR
YVSPGERPSGMFDSVVLCECYDAGCAWYELTPAETTVRLRAYLNTPGLPV
CQDHLEFWESVFTGLTHIDAHFLSQTKQSGENFPYLVAYQATVCARARAP
PPSWDQMWKCLIRLKPTLTGATPLLYRLGSVQNEITLTHPITQYIMACMS
ADLEVVTSTWVLVGGVLAALAAYCLSTGSVVIVGRIILGGKPAVIPDREV
LYREFDEMEECAAHVPYLEQGMHLAEQFKQKALGLLQTASKQAETITPTV
RTNWQKLESFWAKHMWNFVSGIQYLAGLSTLPGNPAIASLMSFTAAVTSP
LTTQQTLLFNILGGWLAAQLAAPAAATAFVGAGITGAVVGSVGLGKVLVD
ILAGYGAGVAGALVAFKIMSGETPTTEDLVNLLPAILSPGALVVAVVCAA
ILRRHVGLGEGAVQWMNRLIAFASRGNHVSPTHYVPESDASARVTQILTS
LTVTQLLKRLHVWISSDCIAPCASSWLKDVWDWICEVLSDFKNWLKAKLV
PQLPGIPFVSCQRGYRGVWRGEGIVHTRCPCGANITGHVKNGSMRIVGPK
TCSNTWRGSFPINAHTTGPCTPSPAPNYTFALWRVSAEEYVEVRRLGDFH
YVTGVTTDKLKCPCQVPSPEFSTEVDGVRLHRYAPPCKPLLRDEVTFSIG
LNEYLVGSQLPCEPEPDVAALTSMLTDPSHITAETAARRLKRGSPPSLAS
SSASQLSAPSLKATCTTHHDSPDADLIEANLLWRREMGGNITRVESENKI
VVLDSFDPLVAEEDDREISIPAEILRKFKQFPPAMPIWARPDYNPPLVEP
WKRPDYEPPLVHGCPLPPPKPTPVPPPRRKRTVVLDESTVSSALAELATK
TFGSSTTSGVTSGEAAESSPALSCDGELDSEAESYSSMPPLEGEPGDPDL
SDGSWSTVSSDGGTEDVVCCSMSYSWTGALITPCAAEETKLPINALSNSL
LRHHNLVYSTTRSAGORQKKVTFDRVQVLDDHYRDVLKEAKAKASTVKA
RLLSVEEACSLTPPHSARSKFGYGPKDVRSHSSKAIRHINSVWQDLLEDN
TTPIDTTIMAKNEVFCVKPEKGGRKPARLIVYPDLGVRVCEKRALYDVVK
QLPIAVMGPSYGFQYSPAQRVDFLLNAWKSKKNPMGFSYDTRCFDSTVTE
ADIRTEEDLYQSCDLVPEARAAIRSLTERLYIGGPLTNSKGQNCGYRRCR
ASGVLTTSCGNTITCYLKASAACRAAKLRDCTMLVCGDDLVVICESAGVK
EDAASLRAFTEAMTRYSGPPGDPAQPEYDLELITSCSSNVSVARDGAGKR
VYYLTRDPETPLARAAWETARHTPVNSWLGNIIMFAPTLWVRMVLMTHFF SILIAQEHLEKALDCEIYGAVHSVQPLDLPEIIQRLHSLSAFSLHSYSPG
EINRVAACLRKLGVPPLRAWRHRARSVRATLLSQGGKAAICGKYLFNWAV
KTKLKLTPLPSMSQLDLSNWFTGGYSGGDIYHSVSHVRPRWFFWCLLLLS
VGVGIYLLPNR Design30.mosaic1_serial Amino Acid Sequence
SEQ ID NO: 45
MSTNPKPQRKTKRNTNRRPQDVKFPGGGQIVGGVYLLPRRGPRLGVRATR
KTSERSQPRGRRQPIPKARQPEGRAWAQPGYPWPLYGNEGMGWAGWLLSP
RGSRPSWGPTDPRRRSRNLGKVIDTLTCGFADLMGYIPLVGAPLGGAARA
LAHGVRVLEDGVNYATGNLPGCSFSIFLLALLSCLTIPASAYEVRNVSGV
YHVTNDCSNSSIVYEAADMIMHTPGCVPCVRENNSSRCWVALTPTLAARN
ASVPTTTIRRHVDLLVGAAAFCSAMYVGDLCGSVFLVSQLFTFSPRRHET

VQDCNCSIYPGHVSGHRMAWDMMMNWSPTTALVVSQLLRIPQAVVDMVAG

AHWGVLAGLAYYSMVGNWAKVLIVMLLFAGVDGHTHVTGGRVASSTQSLV

SWLSQGPSQKIQLVNTNGSWHINRTALNCNDSLQTGFLAALFYTHKFNAS

GCPERMASCRPIDEFAQGWGPITHDMPESSDQRPYCWHYAPRPCGIVPAS

QVCGPVYCFTPSPVVVGTTDRFGVPTYSWGENETDVLLLNNTRPPQGNWF

GCTWMNSTGFTKTCGGPPCNIGGVGNNTLTCPTDCFRKHPEATYTKCGSG

PWLTPRCLVDYPYRLWHYPCTVNFTIFKVRMYVGGVEHRLNAACNWTRGE

RCDLEDRDRSELSPLLLSTTEWQILPCSFTTLPALSTGLIHLHQNIVDVQ

YLYGIGSAVVSFAIKWEYVLLLFLLLADARVCACLWMMLLIAQAEAALEN

LVVLNAASVAGAHGILSFLVFFCAAWYIKGRLVPGAAYALYGVWPLLLLL

LALPPRAYAMDREMAASCGGAVFVGLALLTLSPHYKVFLARLIWWLQYFI

TRAEAHLQVWIPPLNVRGGRDAIILLTCAVHPELIFDITKLLLAILGPLM

VLQAGITRVPYFVRAQGLIRACMLVRKVAGGHYVQMAFMKLAALTGTYVY

DHLTPLRDWAHAGLRDLAVAVEPVVFSDMETKIITWGADTAACGDIILGL

PVSARRGREILLGPADSLEGQGWRLLAPITAYSQQTRGLLGCIITSLTGR

DKNQVEGEVQVVSTATQSFLATCVNGVCWTVYHGAGSKTLAGPKGPITQM

YTNVDQDLVGWQAPPGARSLTPCTCGSSDLYLVTRHADVIPVRRRGDSRG

SLLSPRPVSYLKGSSGGPLLCPSGHAVGIFRAAVCTRGVAKAVDFVPVES

METTMRSPVFTDNSSPPAVPQTFQVAHLHAPTGSGKSTKVPAAYAAQGYK

VLVLNPSVAATLGFGAYMSKAHGVDPNIRTGVRTITTGAPITYSTYGKFL

ADGGCSGGAYDIIICDECHSTDSTTILGIGTVLDQAETAGARLVVLATAT

PPGSVTVPHPNIEEVALSNTGEIPFYGKAIPIETIKGGRHLIFCHSKKKC

DELAAKLSGLGLNAVAYYRGLDVSVIPTSGDVVVVATDALMTGFTGDFDS

VIDCNTCVTQTVDFSLDPTFTIETTTVPQDAVSRSQRRGRTGRGRRGIYR

FVTPGERPSGMFDSSVLCECYDAGCAWYELTPAETSVRLRAYLNTPGLPV

CQDHLEFWESVFTGLTHIDAHFLSQTKQAGDNFPYLVAYQATVCARAQAP

PPSWDQMWKCLIRLKPTLHGPTPLLYRLGAVQNEVTLTHPITKYIMACMS

ADLEVVTSTWVLVGGVLAALAAYCLTTGSVVIVGRIILSGKPAIIPDREV

-continued
```
LYQEFDEMEECASHLPYIEQGMQLAEQFKQKALGLLQTATKQAEAAAPVV
ESKWRALETFWAKHMWNFISGIQYLAGLSTLPGNPAIASLMAFTASITSP
LTTQHTLLFNILGGWVAAQLAPPSAASAFVGAGIAGAAVGSIGLGKVLVD
ILAGYGAGVAGALVAFKVMSGEMPSTEDLVNLLPAILSPGALVVGVVCAA
ILRRHVGPGEGAVQWMNRLIAFASRGNHVSPTHYVPESDAAARVTQILSS
LTITQLLKRLHQWINEDCSTPCSGSWLRDVWDWICTVLTDFKTWLQSKLL
PRLPGVPFFSCQRGYKGVWRGDGIMQTTCPCGAQITGHVKNGSMRIVGPK
TCSNTWHGTFPINAYTTGPCTPSPAPNYSRALWRVAAEEYVEVTRVGDFH
YVTGMTTDNVKCPCQVPAPEFFTEVDGVRLHRYAPACKPLLREEVTFQVG
LNQYLVGSQLPCEPEPDVAVLTSMLTDPSHITAETAKRRLARGSPPSLAS
SSASQLSAPSLKATCTTHHDSPDADLIEANLLWRQEMGGNITRVESENKV
VILDSFDPLRAEEDEREVSVPAEILRKSRKFPRAMPIWARPDYNPPLLES
WKDPDYVPPVVHGCPLPPTKAPPIPPPRRKRTVVLTESTVSSALAELATK
TFGSSESSAVDSGTATAPPDQPSDDGDAGSDVESYSSMPPLEGEPGDPDL
SDGSWSTVSEEASEDVVCCSMSYTWTGALITPCAAEESKLPINALSNSLL
RHHNMVYATTSRSASQRQKKVTFDRLQVLDDHYRDVLKEMKAKASTVKAK
LLSVEEACKLTPPHSARSKFGYGAKDVRNLSSKAVNHIRSVWKDLLEDTE
TPIDTTIMAKNEVFCVQPEKGGRKPARLIVFPDLGVRVCEKMALYDVVST
LPQAVMGSSYGFQYSPGQRVEFLVNAWKSKKCPMGFAYDTRCFDSTVTEN
DIRVEESIYQCCDLAPEARQAIRSLTERLYIGGPLTNSKGQNCGYRRCRA
SGVLTTSCGNTLTCYLKASAACRAAKLQDCTMLVCGDDLVVICESAGTQE
DAASLRVFTEAMTRYSAPPGDPPQPEYDLELITSCSSNVSVAHDASGKRV
YYLTRDPTTPLARAAWETARHTPVNSWLGNIIMYAPTLWARMILMTHFFS
ILLAQEQLEKALDCQIYGACYSIEPLDLPQIIQRLHGLSAFSLHSYSPGE
INRVASCLRKLGVPPLRVWRHRARSVRAKLLSQGGRAATCGKYLFNWAVR
TKLKLTPIPAASQLDLSGWFVAGYSGGDIYHSLSRARPRWFMWCLLLLSV
GVGIYLLPNR Design30.mosaic2_serial Amino Acid Sequence
                                    SEQ ID NO: 46
MSTNPKPQRKTKRNTNRRPQDVKFPGGGQIVGGVYLLPRRGPRLGVRTTR
KTSERSQPRGRRQPIPKARRPEGRTWAQPGYPWPLYGNEGCGWAGWLLSP
RGSRPNWGPTDPRRRSRNLGKVIDTLTCGLADLMGYIPLVGAPLGGAARA
LAHGVRVLEDGVNYATGNLPGCSFSIFLLALLSCLTVPASAYQVRNSTGL
YHVTNDCPNSSIVYEAADAILHTPGCVPCVREGNASRCWVAVTPTVATRD
GKLPTTQLRRHIDLLVGSATLCSALYVGDLCGSVFLVGQLFTFSPRRHWT
TQDCNCSIYPGHITGHRMAWDMMMNWSPTTALVVAQLLRIPQAILDMIAG
AHWGVLAGIAYFSMVGNWAKVLVVLLLFAGVDAGTHVTGGSAAKDTSGFT
SLFRIGARQNIQLINTNGSWHINSTALNCNASLDTGWIAGLFYYHKFNSS
GCPERLASCRPLTDFDQGWGPISYANGSGPDQRPYCWHYPPKPCGIVPAK
SVCGPVYCFTPSPVVVGTTDRSGAPTYSWGENDTDVFVLNNTRPPLGNWF
```

-continued
```
GCTWMNSSGFTKVCGAPPCVIGGVGNNTLHCPTDCFRKHPEATYSRCGSG
PWITPRCLVNYPYRLWHYPCTINYTIFKVRMYVGGVEHRLEAACNWTRGE
RCDLDDRDRSELSPLLLSTTQWQVLPCSFTTLPALTTGLIHLHQNIVDVQ
YLYGVGSSIASWAIKWEYVVLLFLLLADARVCSCLWMMLLISQAEAALEN
LVILNAASLAGTHGLVSFLVFFCFAWYLKGRWVPGAVYALYGMWPLLLLL
LALPQRAYALDTEVAASCGGVVLVGLMALTLSPYYKRYISWCLWWLQYFL
TRVEAQLHVWVPPLNVRGGRDAVILLMCVVHPTLVFDITKLLLAVFGPLW
ILQASLLKVPYFVRVQGLLRICALARKMAGGHYVQMAIIKLGALTGTYVY
NHLTPLRDWAHNGLRDLAVAVEPVVFSQMETKLITWGADTAACGDIINGL
PVSARRGQEILLGPADGMVSKGWRLLAPITAYAQQTRGLLGCIVTSLTGR
DKNQVEGEVQIVSTAAQTFLATCINGVCWTVYHGAGTRTIASPKGPVIQM
YTNVDKDLVGWPAPQGARSLTPCTCGSSDLYLVTRHADVIPVRRRGDGRG
SLLSPRPISYLKGSSGGPLLCPAGHAVGIFRAAVCTRGVAKAVDFIPVEN
LETTMRSPVFTDNSSPPAVPQSFQVAHLHAPTGSGKSTKVPAAYAAQGYT
VLVLNPSVAATLGFGAYMSKAHGIDPNIRTGVRTITTGSPITYSTYGKFL
ADGGCSGGAYDIIICDECHSTDATSILGIGTVLDQAETAGARLTVLATAT
PPGSITVPHPNIEEVALSTTGEIPFYGKAIPLEVIKGGRHLIFCHSKRKC
DELAAKLVALGINAVAYYRGLDVSVIPASGDVVVVATDALMTGYTGDFDS
VIDCNTCVTQTVDFSLDPTFTIETTTLPQDAVSRTQRRGRTGRGKPGIYR
FVAPGERPSGMFDSSILCECYDAGCAWYELTPAETTVRLRAYMNTPGLPV
CQDHLEFWEGVFTGLTHIDAHFLSQTKQSGENLPYLVAYQATVCARAQAL
PPSWDQMWKCLTRLKPTLHGPTPLLYRLGAVQNEITLTHPVTKYIMTCMS
ADLEVVTSTWVLVGGVLAALAAYCLSTGCVVIVGRIVLSGKPAIIPDREV
LYREFDEMEECSQHLPYIEQGMMLEFKQKALGLLQTASRQAEVIAPAV
QTNWQKLEAFWAKHMWNFISGIQYLAGLSTLPGNPAIASLMAFTAAVTSP
LTTSQTLLFNILGGWVAAQLAAPGAATAFVGAGLAGAAIGSVGLGKVLVD
IIAGYGAGVAGALVAFKIMSGEVPSTEDLVNLLPAILSPGALVVGVVCAA
ILRRHVGPGEGAVQWMNRLIAFASRGNHVSPTHYVQESDAAARVTAILSS
LTVTQLLRRLHQWISSECTTPCSGSWLRDIWDWICEVLSDFKTWLKAKLM
PQLPGIPFVSCQRGYRGVWRGDGIMHTRCHCGAEITGHVKNGTMRIVGPR
TCRNMWSGTFPINAYTTGPCTPLPAPNYTFALWRVSAEEYVEIRQVGDFH
YVTGMTTDNLKCPCQVPSPEFFTELDGVRLHRFAPPCKPLLREEVSFRVG
LHEYPVGSQLPCEPEPDVAVLTSMLTDPSHITAEAAGRRLARGSPPSVAS
SSASQLSAPSLKATCTANHDSPDAELIEANLLWRQEMGGNITRVESENKV
VVLDSFDPLVAEEDEREISVPAEILRKSRRFAPALPIWARPDYNPPLLET
WKKPDYEPPVVHGCPLPPPQSPPVPPPRKKRTVVLTESTVSTALAELATK
SFGSSSTSGITGDNTTTSSEPAPSGCPPDSDAESYSSMPPLEGEPGDPDL
SDGSWSTVSSGADTEDVVCCSMSYSWTGALVTPCAAEEQKLPINALSNSL
LRHHNVYSTTSRSACQRQKKVTFDRLQVLDSHYQDVLKEVKAAASKVKA
NLLSVEEACSLTPPHSAKSKFGYGAKDVRCHARKAVNHINSVWKDLLEDS
VTPIDTTIMAKNEVFCVQPEKGGRKPARLIVYPDLGVRVCEKMALYDVVS
```

KLPLAVMGSSYGFQYSPGQRVEFLVQAWKSKKTPMGFSYDTRCFDSTVTE

SDIRTEEAIYQCCDLDPQARVAIKSLTERLYVGGPLTNSRGENCGYRRCR

ASGVLTTSCGNTLTCYIKARAACRAAGLQDCTMLVCGDDLVVICESAGVQ

EDAASLRAFTEAMTRYSAPPGDPPQPEYDLELITSCCSSNVSVAHDGAGKR

VYYLTRDPTTPLARAAWETARHTPINSWLGNIIMFAPTLWARMILMTHFF

SVLIARDQLEQALDCEIYGACYSIEPLDLPPIIQRLHGLSAFSLHSYSPG

EINRVAACLRKLGVPPLRAWRHRARSVRARLLSRGGRAAICGKYLFNWAV

KTKLKLTPIAAAGQLDLSGWFTAGYSGGDIYHSVSHARPRWFWFCLLLLA

AGVGIYLLPNR

Design30.mosaic3_serial Amino Acid Sequence
SEQ ID NO: 47
MSTNPKPQRKTKRNTNRRPQNVKFPGGGQIVGGVCLLPRRGPRVGVRATR

KTSERSQPRGRRQPIPKARRPEGRSWAQPGYPWPLYGNEGCGWAGWLLSP

RGSRPSRGPSDPRRRSRNLGKVIDTLTYGFADLMGYIPLVGAPLGGAARA

LAHGVRVLEDGVNYATGNLPGCSFSIFLLALLSCLTVPASAVGVRNSSGV

YHVTNDCPNASVVYETDSLIIHLPGCVPCVREGNGSRCWVSLSPTVAAKD

PGVPVNEIRRHVDLIAGAAAFCSAMYVGHLCGSIFLVGQLFTLSPRRHWT

TQDCNCSIYPGHVTGHRMAWDMMMNWSPTGALVVAQLLRIPQAVLDMIAG

AHWGVLAGPAYYSMVGNWAKVVVVLLLFAGVDATTQVTGGTAGRNAYRLA

SLFSTGPSQNIQLINSNGSWHINRTALNCNDSLHTGWVAALFYSHKFNSS

GRPERMASCRPLTAFDQGWGPITHEGNASDDQRPYCWHYALRPCGIVPAK

KVCGPVYCFTPSPVVVGTTDRAGVPTYRWGANETDVLLLNNSRPPMGNWF

GCTWMNSSGFTKTCGAPACNVGGSETNTLSCPTDCFRRHPDATYAKCGSG

PWLNPRCMVDYPYRLWHYPCTVNYTIFKIRMFVGGVEHRLDAACNWTRGE

RCDLDDRDRAELSPLLLSTTQWQVLPCSFTTLPALSTGLIHLHQNIVDVQ

YLYGLSSAVTSVVVIKWEYVVLLFLLLADARICACLWMMLLISQVEAALE

NLIVLNAASLVGTHGIVPFFIFFCAAWYLKGKWAPGLAYSVYGMWPLLLL

LLALPQRAYALDQELAASCGATVFICLAVLTLSPYYKQYMARGIWWLQYM

LTRAEALLQVWVPPLNARGGRDGVVLLTCVLHPHLLFEITKIMLAILGPL

WILQASLLRVPYFVRAHGLIRLCMLVRKTAGGHYVQMALLKLGALTGTYI

YNHLSPLQDWAHSGLRDLAVATEPVIFSRMEIKTITWGADTAACGDIING

LPVSARRGREVLLGPADALTDKGWRLLAPITAYAQQTRGLLGCIVTSLTG

RDKNQVEGEIQIVSTATQTFLATCINGACWTVYHGAGSRTIASASGPVVR

MYTNVDQDLVGWPAPQGARSLTPCTCGASDLYLVTRHADVIPVRRRGDNR

GSLLSPRPISYLKGSSGGPLLCPMGHAVGIFRAAVCTRGVAKAVDFVPVE

SLETTMRSPVFTDNSSPPTVPQSYQVAHLHAPTGSGKSTKVPAAYAAQGY

KVLVLNPSVAATLGFGAYMSKAHGIDPNVRTGVRTITTGSPITHSTYGKF

LADGGCPGGAYDIIICDECHSVDATSILGIGTVLDQAETAGVRLTVLATA

TPPGLVTVPHSNIEEVALSADGEKPFYGKAIPLNYIKGGRHLIFCHSKKK

CDELAAKLVGLGVNAVAFYRGLDVSVIPTTGDVVVVATDALMTGFTGDFD

SVIDCNTCVVQTVDFSLDPIFSIETSTVPQDAVSRSQRRGRTGRGKHGIY

RYVSPGERPSGMFDSVVLCECYDAGCAWYELTPAETTVRLRAYLNTPGLP

VCQDHLEFWESVFTGLTHIDAHFLSQTKQSGENFPYLVAYQATVCARARA

PPPSWDQMWKCLIRLKPTLTGATPLLYRLGSVQNEITLTHPITQYIMACM

SADLEVVTSTWVLVGGVLAALAAYCLSTGSVVIVGRIILGGKPAVIPDRE

VLYREFDEMEECAAHVPYLEQGMHLAEQFKQKALGLLQTASKQAETITPT

VRTNWQKLESFWAKHMWNFVSGIQYLAGLSTLPGNPAIASLMSFTAAVTS

PLLTQQTLLFNILGGWLAAQLAAPAAATAFVGAGITGAVVGSVGLGKVLV

DILAGYGAGVAGALVAFKIMSGETPTTEDLVNLLPAILSPGALVVAVVCA

AILRRHVGLGEGAVQWMNRLIAFASRGNHVSPTHYVPESDASARVTQILT

SLTVTQLLKRLHVWISSDCIAPCASSWLKDVWDWICEVLSDFKNWLKAKL

VPQLPGIPFVSCQRGYRGVWRGEGIVHTRCPCGANITGHVKNGSMRIVGP

KTCSNTWRGSFPINAHTTGPCTPSPAPNYTFALWRVSAEEYVEVRRLGDF

HYVTGVTTDKLKCPCQVPSPEFSTEVDGVRLHRYAPPCKPLLRDEVTFSI

GLNEYLVGSQLPCEPEPDVAALTSMLTDPSHITAETAARRLKRGSPPSLA

SSSASQLSAPSLKATCTTHHDSPDADLIEANLLWRREMGGNITRVESENK

IVVLDSFDPLVAEEDDREISIPAEILRKFKQFPPAMPIWARPDYNPPLVE

PWKRPDYEPPLVHGCPLPPPKPTPVPPPRRKRTVVLDESTVSSALAELAT

KTFGSSTTSGVTSGEAAESSPALSCDGELDSEAESYSSMPPLEGEPGDPD

LSDGSWSTVSSDGGTEDVVCCSMSYSWTGALITPCAAEETKLPINALSNS

LLRHHNLVYSTTSRSAGQRQKKVTFDRVQVLDDHYRDVLKEAKAKASTVK

ARLLSVEEACSLTPPHSARSKFGYGPKDVRSHSSKAIRHINSVWQDLLED

NTTPIDTTIMAKNEVFCVKPEKGGRKPARLIVYPDLGVRVCEKRALYDVV

KQLPIAVMGPSYGFQYSPAQRVDFLLNAWKSKKNPMGFSYDTRCFDSTVT

EADIRTEEDLYQSCDLVPEARAAIRSLTERLYIGGPLTNSKGQNCGYRRC

RASGVLTTSCGNTITCYLKASAACRAAKLRDCTMLVCGDDLVVICESAGV

KEDAASLRAFTEAMTRYSGPPGDPAQPEYDLELITSCSSNVSVARDGAGK

RVYYLTRDPETPLARAAWETARHTPVNSWLGNIIMFAPTLWVRMVLMTHF

FSILIAQEHLEKALDCEIYGAVHSVQPLDLPEIIQRLHSLSAFSLHSYSP

GEINRVAACLRKLGVPPLRAWRHRARSVRATLLSQGGKAAICGKYLFNWA

VKTKLKLTPLPSMSQLDLSNWFTGGYSGGDIYHSVSHVRPRWFFWCLLLL

SVGVGIYLLPNR

Design30.mosaic4_serial Amino Acid Sequence
SEQ ID NO: 48
MSTNPKPQRKIKRNTNRRPQDVKFPGGGQIVGGVYLLPRRGPRLGVRAPRKT

SERSQPRGRRQPIPKARRPEGRAWAQPGYPWPLYGNEGLGWAGWLLSPRG

-continued

```
SRPSWGPNDPRRRSRNLGKVIDTLTCGFADLMGYIPLVGAPLGGVARALAHGV

RVVEDGVNYATGNLPGCSFSIFLLALLSCLTVPASAYQVRNSSGLYHVTNDCSN

ASIVYEAADVIMHTPGCVPCVREGNSSRCWVALTPTLAARNSSIPTTTIRRHVDL

LVGAAALCSAMYVGDFCGSVFLVSQLFTFSPRRYETVQDCNCSLYPGHVSGH

RMAWDMMMNWSPTAALVVSQLLRIPQAIMDMVAGAHWGVLAGLAYYSMAGN

WAKVLIVMLLFAGVDGGTHVTGGKVAYTTQGFTSFFSRGPSQKIQLVNTNGSW

HINRTALNCNDSLNTGFLAALFYTHKFNASGCPERMASCRSIDKFDQGWGPITY

AEPHDLDQRPYCWHYPPQPCGIVPAAQVCGPVYCFTPSPVVVGTTDRSGAPT

YNWGENETDVFILNNTRPPQGNWFGCTWMNGTGFTKTCGGPPCNIGGAGNN

TLICPTDCFRKHPEATYAKCGSGPWLTPRCLVHYPYRLWHYPCTVNFTVFKVR

MYVGGVEHRLHAACNWTRGERCNLEDRDRSELSPLLLSTTEWQVLPCSFTTL

PALSTGLIHLHRNIVDVQYLYGVGSSIVSWAIKWEYVILLFLLLADARICSCLWMM

LLISQAEAALENLVVLNAASVAGTHGILSLLVFFCAAVVYIKGKLVPGAAYAFYGV

WPLLLLLMALPARAYAMDREMAASCGGAVFVGLVLLTLSPYYKVFLAKLIWWL

QYFITRAEAHLQVWVPPLNVRGGRDAIILLTCAIHPELIFTITKILLAILGPLMVLQA

GLTQMPYFVRAQGLIRACMLVRKAAGGHYVQMALMKLAALTGTYVYDHLTPLQ

DWAHVGLRDLAVAVEPVIFSDMETKIITWGAETAACGDIISGLPVSARRGKEILL

GPADSFGEQGWRLLAPITAYSQQTRGLFGCIITSLTGRDRNQVEGEVQVVSTA

TQSFLATCINGVCWTVFHGAGSKTLAGPKGPVTQMYTNVDQDLVGWPAPPGA

RSMTPCTCGSSDLYLVTRHADWPVRRRGDSRGSLLSPRPVSYLKGSSGGPLL

CPSGHVVGIFRAAVCTRGVAKAVDFIPVESMETTMRSPVFTDNSSPPVVPQSF

QVAYLHAPTGSGKSTRVPAAYAAQGYKVLVLNPSVAATLSFGAYMSKAYGTDP

NIRTGVRTITTGASITYSTYGKFLADGGCSGGAYDIIMCDECHSTDSTSILGIGTV

LDQAETAGARLVVLATATPPGSVTVPHSNIEEVALSNIGEIPFYGKAIPIEAIKGG

RHLIFCHSKKKCDELAAKLSALGVNAVAYYRGLDVSVIPTSGNVVVVATDALMT

GYTGDFDSVIDCNTCVIQTVDFSLDPTFTIDTTTVPQDAVSRTQRRGRTGRGRG

GIYRFVTPGERPSGMFDSSVLCECYDAGCAVVYELTPAVTSVRLRAYLNTPGLP

VCQVHLEFWESVFTGLTHIDAHFLSQTKQAGENFPYLTAYQATVCARSQAPPP

SWDQMWKCLIRLKPTLHGATPLLYRLGAVQNEITLTHPITKFIMACMSADLEIVT

STVVVLVGGVLAALAAYCLSTGCVVIVGRVVLSGKPAIIPDREVLYKEFDEMEEC

SQHLPYIEQGMALAEQFKQKALGLLQTASRQAEVITPAVQTNWQKLEVFWAKH

MWNFISGVQYLAGLSTLPGNPAIASLMAFTASVTSPLTTQSTLLFNILGGVVVAA

QLAPPSAASAFVGAGIAGAAIGSIGLGKVLVDILAGYGAGVAGALVAFKVMSGD

MPSTEDLVNLLPAILSPGALWGVVCAAILRRHVGPGEGAVQWMNRLIAFASRG

NHVSPTHYVPESDAAARVTTILSSLTVTQLLRRLHQWISSDCTTPCSGSWLKDV

WDWICTVLSDFKTWLQTKLLPRLPGVPFLSCQRGYKGVWRGDGIMHTTCPCG

AQIAGHVKNGSMRIVGPRTCSNTWHGTFPINAYTTGPCVPSPAPNYSKALWRV

AAEEYVEVTRVGDSHYVTGMTTDNIKCPCQVPAPEFFTELDGVRLHRYAPACK

PLLRDEVTFQVGLNQYVVGSQLPCEPEPDVTVLTSMLTDPSHITAEAARRRLAR

GSPPSLARSSASQLSAPSLKATCTTRHDSPDADLIEANLLWRQEMGGNITRVES
```

-continued

ENKWILDSFEPLRAEEDEREVSVAAEILRKTRKFPAAMPVWARPDYNPPLIES

WKDPDYVPPVVHGCPLPPIKAPPIPPPRRKRTVVLSESTVSSALAELATKTFGS

SGSSAVDSGTATAPPDQASDDGDKGSDVESYSSMPPLEGEPGDPDLSDGSW

STVSSEAGTEDVVCCSMSYTWTGALITPCAAEESKLPINPLSNSLLRHHSMVYS

TTSRSASLRQKKVTFDRLQVLDNHYQDVLKEMKAKASTVKAKLLSIEEACKLTP

PHSAKSKFGYGAKDVRSLSSRAVNHIRSVWEDLLEDTETPIDTTIMAKSEVFCV

QPEKGGRKAARLIVFPDLGVRVCEKMALYDVVSKLPLAVMGSSYGFQYSPKQR

VEFLVNTWKSKKCPMGFSYDTRCFDSTVTESDIRVEESIYQCCDLAPEARQAIK

SLTERLYIGGPLTNSRGENCGYRRCRASGVLTTSCGNTLTCYIKAQAACRAAGL

RDCTMLVNGDDLVVICESAGTQEDEASLRVFTEAMTRYSAPPGDPPKPEYDLE

LITSCSSNVSVAHDATGKRVYYLTRDPATPLARAAWETVRHTPVNSWLGNIIMY

APTLWARMVLMTHFFSILLAQEQLDKALDCQIYGATYSIEPLDLPQIIERLHGLSA

FSLHSYSPGEINRVAACLRKLGVPPLRVWRHRARSVRARLLSQGGRAAICGRY

LFNWAVKTKLKLTPIAAASQLDLSGWFTAGYSGGDIYHSVSRARPRWFMLCLLL

LSVGVGIYLLPNR

Design32.mosaic1 Amino Acid Sequence
                                                    SEQ ID NO: 49
MSTLPKPQRKTKRNTNRRPQDVKFPGGGQIVGGVYLLPRRGPRLGVRAVRKT

SERSQPRGRRQPIPKARQPQGRHWAQPGYPWPLYGNEGMGWAGWLLSPRG

SRPNWGPNDPRRRSRNMGKVIDSLTCGFADLMGYIPVLGAPLGGVAAALAHG

VRAIEDGINYATGNLPGCSFSIFLLALLSCLTTPASALTYGNSSGLYHLTNDCPN

SSIVLEADAMILHLPGCLPCVRVDNRSTCWHAVSPTLAIPNASTPATGFRRHVD

LLAGAAWCSSLYIGDLCGSLFLAGQLFTFQPRRHWTVQDCNCSIYTGHVTGH

RMAWDMMMNWSPTTTLVLSSILRVPEICASVIFGGHWGILLAVAYFGMAGNWL

KVLAVLFLFAGVEATTTIGHEVGRASATLAGMFSSGARQNLQLINTNGSWHINS

TALNCNDSLQTGFIASLFYAHRFNSSGCPERMAACKPLADFRQGWGQITYKVNI

SGPSDDRPYCWHYAPRPCGIVPASEVCGPVYCFTPSPWVGTTDRSGVPTYN

WGENETDVFMLESLRPPTGWFGCTWMNSSGFTKTCGAPPCQIVPGDYNSS

ANELLCPTDCFRKHPEATYQRCGSGPWLTPRCLVDYPYRLWHYPCTVNFTLH

KVRMFVGGIEHRFDAACNWTRGERCELHDRDRIEMSPLLFSTTQLAILPCSFTT

MPALSTGLIHLHQNIVDVQYLYGVSSSVTSVVVVKWEYIVLMFLVLADARICTCL

WLMLLISNVEAAVERLVVLNAASAAGTAGWWWAVLFLCCVWYVKGRLVPACT

YMALGMWPLLLTILALPPRAYAMDNEQAASLGAVGLLVITIFTITPMYKKLLTCFI

WWNQYFLARAEAMIHEWVPDLRVRGGRDSIILLTCLLHPQLGFEVTKILLAILAP

LYILQYSLLKVPYFVRAHILLRACLLVRRLAGGKYVQACLLRLGAWTGTFVYDHL

TPLSDWASDGLRDLAVAVEPVIFSPMEKKVITWGADTAACGDILSGLPVSARLG

NLVLLGPADDMQRGGWKLLAPITAYAQQTRGLVGTIVTSLTGRDKNEVEGEVQ

VVSTATQSFLATSINGVMWTVYHGAGSKTLAGPKGPVCQMYTNVDQDLVGWP

APQGTRSLTPCTCGSSDLYLVTREADVIPARRRGDNRAALLSPRPISTLKGSSG

GPIMCPSGHVVGLFRAAVCTRGVAKSLDFIPVENMETTMRSPSFTDNSTPPAV

-continued

```
PQSYQVGYLHAPTGSGKSTRVPAAYASQGYKVLVLNPSVAATLSFGSYMRQA

YGVEPNVRTGVRTITTGGAITYSTYGKFFADGGCSGGAYDVIICDECHSTDPTT

VLGIGTVLDQAETAGCRLTVLATATPPGSITVPHPNITESALPTTGEVPFYGKAIP

IEVIKGGRHLIFCHSKKKCDELAKQLTSLGLNAVAFYRGVDVSVIPTSGDVWCA

TDALMTGFTGDFDSVIDCNVSVTQWDFSLDPTFSIETTTVPQDAVSRTQRRGR

TGRGKPGVYRFVSQGERPSGMFDTVVLCEAYDTGCAVVYELSPSETTVRLRAY

LNTPGLPVCQDHLEFWEGVFTGLTHIDAHFLSQTKQGGENFAYLTAYQATVCA

RALAPPPSWDTMWKCLIRLKPTLTGPTPLLYRLGAVQNEIITTHPITKYIMTCMS

ADLEVITSTWVLVGGVLAALAAYCLSVGCWICGRITLTGKPAWPDREILYQQF

DEMEECSRHIPYLAEGQQIAEQFRQKVLGLLQASAKQAEELKPAVHSAWPKLE

QFWQKHLWNFVSGIQYLAGLSIWPGNPAVASLMSFSASLTSPLSTSTTLLLNIL

GGWIATQVAPPPASTAFVVSGLAGATVGSIGLGRVLVDVLAGYGAGVSGALVA

FKIMSGECPTTEDMVNLLPALLSPGALWGVVCPAILRRHVGPAEGANQWMNR

LIAFASRGNHGSPTHYVPETDASKNVTQILTSLTITSLLRRLHQWVNEDTATPCA

TSWLRDVWDVVVCTVLSDFKVWLQAKLLPRLPGIPFLSCQTGYRGVWAGDGVC

HTTCTCGAVIAGHVKNGTMKITGPKTCSNTWHGTFPINATTTGPSTPRPAPNYQ

RALWRVSAEDYVEVRRLGDCHYWGVTAEGLKCPCQVPAPEFFTEVDGVRIH

RYAPPCKPLLRDEVTFSVGLSNYAIGSQLPCEPEPDVTWTSMLTDPTHITAETA

ARRLKRGSPPSLASSSASQLSAPSLKATCTTSKDHPDMELIEANLLWRQEMGS

NITRVESENKVWLDSFEPLTAEYDEREISVSAECHRPPRHKFPPALPIWARPDY

NPPLLQAWQMPGYEPPWSGCAVAPPKPAPIPPPRRKRLVHLDESTVSHALAQ

LADKVFVESSNDPGPSSDSGLSITSPVPPAPSTPDDACSEAESYSSMPPLEGE

PGDPDLSSGSWSTVSDQDDVVCCSMSYTWTGALITPCAAEEEKLPINPLSNSLI

RHHNMVYSTTSRSASLRQKKVTFDRVQVFDQHYQDVLKEIKLRASTVQARLLSI

EEACDLTPSHSARSKYGYGAQDVRSHASKAINHIRSVWEDLLEDSDTPIPTTIM

AKNEVFCVDPSKGGRKPARLIVYPDLGVRVCEKMALYDVTQKLPQAVMGSAY

GFQYSPNQRVEYLLKMWRSKKVPMGFSYDTRCFDSTVTERDIRTENDIYQSCQ

LDPVARKAVSSLTERLYVGGPMFNSKGQTCGYRRCRASGVLPTSMGNTITCYL

KAQAACRAANIKDCDMLVCGDDLVVICESAGVQEDTASLRAFTDAMTRYSAPP

GDAPQPTYDLELITSCSSNVSVAHDGNGKRYYYLTRDCTTPLARAAWETVRHS

PVNSWLGNIIMFAPTIVVVRMVLMTHFFSILQSEQQLEKALDFDIYGVTYSVSPLD

LPAIIQRLHGMAAFSLHGYSPGELNRVAACLRKLGAPPLRAWRHRARAVRAKLI

AQGGKAAICGKYLFNWAVRTKLKLTPLVSASKLDLSGWFVAGYDGGDIYHSVS

QARPRLLLLGLLLLTVGVGIFLLPAR

Design32.mosaic2 Amino Acid Sequence
                                          SEQ ID NO: 50
MSTNPKPQ -continued

TWQLTNAVLHLPGCVPCENDNGTLRCWIQVTPNVAVKHRGALTHNLRTHVDMI

VMAATVCSALYVGDVCGAVMIVSQALIVSPERHNFTQECNCSIYQGHITGHRMA

WDMMLNWSPTLTMILAYAARVPELVLEIVFGGHWGVVFGLAYFSMQGAWAKVI

AILLLVAGVDATTYSTGAQAGRGASGIANLFTPGAKQNIQLINTNGSWHINRTAL

NCNASLDTGWVAGLFYYHKFNSSGCPERMSSCRGLDDFRIGWGTLEYETNVT

NDEDMRPYCWHYPPKPCGIVPARSVCGPVYCFTPSPVWGTTDRLGVPTYTW

GENETDVFLLNSTRPPRGAWFGCTWMNSTGFTKTCGAPPCRIRADFNASTDLL

CPTDCFRKHPDATYLKCGAGPWLTPRCLVNYPYRLWHYPCTVNFTIFKVRMYV

GGVEHRLSAACNFTRGDRCRLEDRDRGQQSPLLHSTTEWAVLPCSFSDLPAL

STGLLHLHQNIVDVQYLYGVGSAVVSWALKWEYVVLAFLLLADARVCACLWMLI

ILGQAEAALEKLIILHSASAASANGPLWFFIFFTAAWYLKGRVVPVATYSVLGLW

SFLLLVLALPQQAYALDAAEQGELGLVILVIISIFTLTPAYKILLSRSVWWLSYMLV

LAEAQIQQWVPPLEARGGRDGIIVVVAVILHPRLVFEVTKWLLALLGPAYLLKASL

LRVPYFVRAHALLRVCTLVRHLAGARYIQMLLITIGRWTGTYIYDHLSPLSTWAA

QGLRDLAVAVEPIIFSPMEKKVIVWGAETVACGDILHGLPVSARLGREVLLGPAD

GYTSKGWKLLAPITAYSQQTRGLLGAIWSMTGRDKTEQAGEIQVLSTVTQSFL

GTSISGVLWTVYHGAGNKTLAGSRGPVTQMYSSAEGDLVGWPSPPGTKSLEP

CTCGAVDLYLVTRNADVIPARRGDKRGALLSPRPLSTLKGSSGGPVLCPRGH

AVGIFRAAVCSRGVAKSIDFIPVETLDIVTRSPTFSDNSTPPAVPQTYQVGYLHA

PTGSGKSTKVPVAYAAQGYKVLVLNPSVAATLGFAYLSKAHGINPNIRTGVRT

VTTGGAITYSTYGKFLADGGCAGGAYDIIICDECHSVDATTILGIGTVLDQAETAG

VRLTVLATATPPGSVTTPHPNIEEVALGQEGEIPFYGRAIPLSYIKGGRHLIFCHS

KKKCDELAAALRGMGLNAVAYYRGLDVSVIPTQGDWWATDALMTGFTGDFD

TVIDCNVAVTQVVDFSLDPTFTIETTTMPQDAVSRSQRRGRTGRGRGGIYRFVT

PGERPSAMFDSSVLCECYDTGCAWYELTPSETTVRLRAYFNTPGLPVCQDHLE

FWEAVFTGLTHIDAHFLSQTKQSGENFPYLVAYQATVCARAKAPPPSWDVMW

KCLTRLKPTLVGPTPLLYRLGSVTNEVTLTHPVTKYIATCMQADLEVMTSTWVL

AGGVLAAVAAYCLATGCVSIIGRLHINQRAWAPDKEVLYEAFDEMEECASRAA

LIEEGQRIAEMLKSKIQGLLQQASKQAQDIQPAIQSSWPKLEQFWAKHMWNFV

SGIQYLAGLSTLPGNPAVASMMAFSAALTSPLSTSTTILLNIMGGWLASQIAPPA

GATGFVVSGLVGAAVGSIGLGKILVDVLAGYGAGISGALVAFKIMSGEKPSVED

WNLLPAILSPGALWGVICAAILRRHVGQGEGAVQWMNRLIAFASRGNHVAPT

HYVAESDASQRVTQVLSSLTITSLLRRLHAWITEDCPVPCSGSWLRDIWDWVC

SILTDFKNWLTSKLFPKMPGLPFISCQKGYRGVWAGTGIMTTRCPCGANISGNV

RLGSMRITGPKTCMNTWQGTFPINCYTEGQCVPKPAPNFKTAIWRVAASEYVE

VTQHGSFSYVTGLTSDNLKVPCQLPSPEFFSWVDGVQIHRFAPTPKPFFRDEV

SFCVGLNSFWGSQLPCDPEPDTEVLASMLTDPSHITAEAAARRLARGSPPSQ

ASSSASQLSAPSLRATCTTHGKTYDVDMVDANLFMGGDVTRIESDSKVIVLDSL

DSMTEVEDDREPSVPSEYLIRRRKFPPALPPWARPDYNPPVIETWKRPGYEPP

TVLGCALPPTPQAPVPPPRRRRAKVLTQDNVEGVLREMADKVLSPLQDHNDS

GHSTGADTGGDSVQQPSDETAASEAGSLSSMPPLEGEPGDPDLEFEPAGSAP

-continued

PSEGECEVIDSDSKSWSTVSDQEDSVICCSMSYSWTGALITPCGPEEEKLPISP
LSNSLMRFHNKVYSTTSRSASLRAKKVTFDRVQVLDAHYDSVLKDIKLAASKVS
ARLLSVEEACALTPPHSAKSKFGYGAKDVRSHSRKAINHINSVWEDLLEDQHTP
IDTTIMAKNEVFCVDPTKGGKKAARLIVYPDLGVRVCEKRALYDIAQKLPKAVMG
PSYGFQYSPAQRVDFLLNAWKSKKNPMGFSYDTRCFDSTVTERDIRTEESIYQ
ACSLPQEARTVIHSLTERLYVGGPMTNSKGQSCGYRRCRASGVFTTSMGNTM
TCYIKALAACKAAGIVDPIMLVCGDDLWISESQGNEEDERNLRAFTEAMTRYSA
PPGDLPRPEYDLELITSCSSNVSVALDSRGRRRYFLTRDPTTPIARAAWETVRH
SPVNSWLGNIIQYAPTIWVRMVIMTHFFSILLAQDTLNQNLNFEMYGAVYSVNPL
DLPAIIERLHGLDAFSLHTYSPHELSRVAATLRKLGAPPLRAWKSRARAVRASLI
AQGGRAAICGRYLFNWAVKTKLKLTPLPEASRLDLSGWFTVGAGGGDIFHSVS
HARPRLLLLCLLLLSVGVGIFLLPAR

Design32.mosaic3 Amino Acid Sequence
SEQ ID NO: 51
MSTNPKPQRQTKRNTNRRPQNVKFPGGGQIVGGVYLLPRKGPRLGVRAPRKT
SERSQPRGRRQPIPKDRRSTGKSWGKPGYPWPLYGNEGLGWAGWLLSPRGS
RPSWGPNDPRHRSRNVGKVIDTLTCGFADLMGYIPVVGAPLGGVARALAHGV
RALEDGINFATGNLPGCSFSIFLLALLSCLTIPASAIEVRNVSGVYHVTNDCSNAS
IVYEAADMIMHTPGCVPCVREGNSSRCWVALTPTLAARNSSIPTTTIRRHVDLLV
GTAAFCSAMYVGDLCGSVFLVSQLFTFSPRRYETVQDCNCSIYPGHVSGHRM
AWDMMMNWSPTTALWSQLLRIPQAWDMVAGAHWGVLAGLAYYSMVGNWA
KVLIVMLLFAGVDGNTHVTGGQAGQHAIRFTSLFSSGASQKIQLVNSNGSWHIN
RTALNCNDSLQTGFLAALFYTHRFNASGCPERMASCRPIDKFAQGWGPITYAE
PPDLDQKPYCWHYAPQPCGIVPASQVCGPVYCFTPSPVVVGTTDRFGVPTYS
WGENETDVLLLNNTRPPRGNWFGCTWMNGTGFTKTCGGPPCNIGGVGNDTLI
CPTDCFRKHPEATYAKCGSGPWLTPRCMVDYPYRLWHYPCTLNFSIFKIRMYV
GGVEHRLNAACNWTRGERCDLEDRDRSELSPLLLSTTEWQILPCSFTTLPALS
TGLIHLHRNIVDVQYLYGIGSAVVSFAIKWEYVLLLFLLLADARVCACLWMMLLIA
QAEAALENLVVLNAASVAGTHGILSFLVFFCAAVVYIKGRLVPGAAYALYGVWPL
LLLLLALPPRAYAMDREMAASCGGAVFIGLALLTLSPHYKVFLARLIWWSQYLIT
RAEAHLQVWVPPLNVRGGRDAIILLMCAIHPELIFTITKILLAILGPLMVLQAGITR
VPYFVRAHGLIRACMLVRKAAGGHYVQMALMKLAALTGTYVYDHLTPLRDWAH
AGLRDLAVAVEPWFSDMETKVITWGADTAACGDIILGLPVSARRGREILLGPAD
SLEGQGWRLLAPITAYAQQTRGLLGTIVTSLTGRDTNENCGEVQVLSTATQSFL
ATCVNGVCWTVYHGAGTKTLAGQKGPITQMYTNVDQDLVGWPAPPGARSMT
PCTCGSSDLYLVTRHADVIPVRRRGDSRGSLLSPRPISYLKGSSGGPLLCPSGH
WGIFRAAVCTRGVAKAVDFVPVESMETTMRSPVFTDNSTPPAVPQTYQVAHL
HAPTGSGKSTKVPAAYAAQGYKVLVLNPSVAATLGFGAYMSKAHGVDPNIRTG
VRTITTGSSITYSTYGKFLADGGCSGGAYDIIMCDECHSTDSTSILGIGTVLDQAE
TAGVRLVVLATATPPGSVTVPHPNIEEVALSNTGEIPFYGKAIPLEAIKGGRHLIF -continued

CHSKKKCDELAAKLSALGVNAVAYYRGLDVSIIPTSGDVVVVATDALMTGYTGN

FDSVIDCNVAVTQIVDFSLDPTFTITTQTVPQDAVSRSQRRGRTGRGRLGIYRY

VSSGERPSGMFDSWLCECYDAGAAWYELTPAETSVRLRAYLNAPGLPVCQD

HLEFWEGVFTGMTHIDAHFLSQTKQAGDNFPYLVAYQATVCARAQAPPPSWD

QMWKCLIRLKPTLHGPTPLLYRLGAVQNEVTLTHPITKFIMACMSADLEVATST

VVVLVGGVLAALAAYCLSVGSVVIVGRIILSGRPAVIPDREVLYQQFDEMEECAT

HLPYIEQGMQLAEQFKQKALGLLQTASKQAEAAAPVVESKWRALESFWAKHM

WNFISGIQYLAGLSTLHGNPAIASLMAFTASITSPLTTQHTLLFNILGGVVVAAQLA

PPSAASAFVGAGIAGAAVGSIGLGKVLVDILAGYGAGVAGALVAFKVMSGEMPS

TEDLVNLLPALLSPGALWGWCAAILRRHAGPAEGATQWMNRLIAFASRGNHV

SPTHYVPESDAAARVTQILSSLTITQLLKRLHQWINEDCSTPCSGSWLRDVWD

WICTVLSDFKTWLQSKLLPRLPGVPFLSCQRGYKGVWRGDGVMQTTCPCGAQ

IAGHVKNGSMRIVGPRTCSNTWHGTFPINAYTTGPCTPSPAPNYSRALWRVAA

EEYVEVTRVGDFHYVTGMTADNIKCPCQVPAPEFFTELDGVRLHRYAPACRPL

LRDEVTFQVGLNQYPVGSQLPCEPEPDVSVLTSMLRDPSHITAEAARRRLARG

SPPSEASSSASQLSAPSLKATCTTRHDSPDADLIEANLLWRQEMGGNITRVESE

TKWILDSFEPLRAEEDEREVSVPAEILRRSRKFPRAMPIWARPDYNPPLVESW

KDPDYVPPVVHGCPLPPAKAPPIPPPRRKRTWLTESTVSSALAELATKTFGSS

ESSAVDSGTATAPPDQPSDDGDAGSDVGSYSSMPPLEGEPGDPDLSDGSWS

TVSEEASEDVVCCSMSYTWTGALITPCSAEESKLPINALSNSLLRRHNMVYATT

SRSASQRQKKVTFDRMQVLDDHYRDVLKEMKAKASTVKAKLLSVEEACKLTPP

HSARSKFGYGAKDVRNLSSKAVNHIRSVWKDLLEDTETPLDTTVMAKNEVFCV

QPEKGGRKPARLIVYPDLGVRVCEKMALYDVTRKLPQAVMGASYGFQYSPGQ

RVEFLVNAWKSKKSPMGFAYDTRCFDSTVTESDIRVEESIYQCCDLAPEARQAI

RSLTERLYIGGPLTNSKGQNCGYRRCRASGVLTTSCGNTLTCYIKAQAACRAA

GLRDCTMLVCGDDLWICESAGVQEDAASLRAFTEAMTRYSAPPGDPPRPEYD

LELITSCSSNVSVAHDGTGQRYYYLTRDPTGPLARAAWETARHTPVNSWLGNII

MYAPTIVVVRMVLOTHFFQILQAQEQLHKALDFDMYGVTYSITPLDLPQIIQRLHG

LSAFTLHSYSPGEINRVAACLRKLGVPPLRVWRHRARSVRARLLSQGGRAATC

GKYLFNWAVKTKLKLTPIAAASQLDLSGWFVAGYSGGDIYHSVSRARPRWFM

WCLLLLSVGVGLFLLPAR

Design32.mosaic4 Amino Acid Sequence

SEQ ID NO: 52

MSTNPKPQRKTQRNTNRRPTDVKFPGGGQIVGGVYLLPRRGPRLGVRATRKT

SERSQPRGRRQPIPKARRPEGRTWAQPGYPWPLYGNEGMGWTGWLLSPRG

SRPSWGPTDPRRRSRNLGKVIDTITCGFADLMGYIPVLGGPLGGVAAALAHGV

RVLEDSVNYATGNLPGCPFSIFLLALLSCLTIPASAYEVRNVSGIYHVTNDCSNS

SIVYEADHHILHLPGCVPCVRENNSSRCVVVALTPTLAARNASVPTTTIRRHVDLL

VGAAAFCSAMYVGDLCGSVFLISQLFTFSPRRHETVQDCNCSIYPGTITGHRMA

WDMMMNWSPTATMILAYAMRVPEVIIDIISGAHWGVMFGLAYFSMQGAWAKV

-continued

```
WILLLLAAGVDARTHTVGGSAAQTTGRLTSLFDMGPRQKIQLVNTNGSWHINRT
ALNCNDSLNTGFLAALFYTHKFNASGCPERMASCRPLADFDQGWGPISHWPN
ISDQRPYCWHYAPRPCSVVSASTVCGPVYCFTPSPWVGTTDRFGAPTYSWG
ENETDVLLLNNTRPPQGNWFGCTWMNGTGFTKTCGVPPCNIGGVGNNTLTCP
TDCFRKHPEATYTKCGSGPWLTPRCIVDYPYRLWHYPCTINYTIFKVRMYVGG
VEHRLDAACNWTRGERCNLEDRDRSELSPLLLSTTEWQVLPCSFTTLPALSTG
LIHLHQNWDVQYLYGVGSSIVSWAIKWEYVILLFLLLADARICSCLWMMLLISQA
EAALENLVILNAASVAGAHGILSFLVFFCAAVVYIKGKLVPGAAYAFYGVWPLLLL
LLALPPRAYALDREMAASCGGAVFVGLVLLTLSPYYKVFLARLIWWLQYFITRAE
AHLQVWIPPLNVRGGRDAIILLTCAVHPELIFDITKLLLAILGPLMVLQAGMTRVP
YFVRAQGLIRACMLVRKVAGGHYVQMAFMKLAALTGTYVYDHLTPLQDWAHT
GLRDLAVAVEPVVFSDMETKIITWGADTAACGDIISGLPVSARRGKEILLGPADS
FGEQGWRLLAPITAYSQQTRGLLGCIVTSLTGRDKNQVEGEVQVVSTATQSFL
ATCINGVCWTVFHGAGSKTLAGPKGPITQMYTNVDQDLVGWQAPPGARSLTP
CTCGASDLYLVTRNADVIPVRRGDGRGSLLSPRPVSYLKGSSGGPLLCPSGH
AVGIFRAAVCTRGVAKAVDFIPVESLETTMRSPVFTDNSSPPAVPQTFQVAHLH
APTGSGKSTKVPAAYVAQGYSVLVLNPSVAATLGFGAYMSKAYGIDPNIRSGV
RTITTGAPITYSTYGKFLADGGCSGGAYDIIICDECHSTDSTTILGIGTVLDQAETA
GARLWLATATPPGTVTTPHSNIEEVALGHEGEIPFYGKAIPIETIKGGRHLIFCH
SRKKCDELAAKLSGLGLNAVAYYRGLDVSVIPTSGNWWATDALMTGYTGDF
DSVIDCNTCVTQTVDFSLDPTFTIETTTVPQDAVARSQRRGRTGRGRRGIYRFV
TPGERPSGMFDSSVLCECYDAGAAWYELTPAETTTRLRAYFNTPGLPVCQDHL
EFWESVFTGLTHIDAHFLSQTKQAGENFAYLVAYQATVCARAKAPPPSWDQM
WKCLTRLKPTLHGPTPLLYRLGSVQNEVTLTHPITKYIMACMSADLEVVTSTWV
LVGGVLAALAAYCLTTGSVVIVGRIILSGKPAVIPDREVLYQEFDEMEECASHLP
YIEQGMQLAEQFRQKALGLLQTATKQAEAAAPVVESKWRALETFWAKHMWNFI
SGIQYLAALSTLPGNPAVASLMAFTASVTSPLTTQSTLLFNILGGVVVASQLANPT
ASTAFWSGLAGAAVGSVGLGKILVDILAGYGAGISGALVAFKIMSGEKPSMEDV
VNLLPGILSPGALWGVVCAAVLRRHVGPSEGAAQWMNRLIAFASRGNHVAPT
HYVTESDASQRVTQLLGSLTITSLLRRLHNWITEDCPIPCAGSWLRDVWDWICT
VLTDFKTWLQSKLMPRLPGVPFFSCQRGYKGVWRGDGIMQTTCPCGAQITGH
VKNGSMRIVGPKTCSNTWHGTFPINAYTTGPGVPVPAPNYKFALWRVSAEEYV
EVRRVGDFHYVTGMTTDNVKCPCQVPAPEFFTEVDGVRLHRYAPACKPLLRE
EVTFQVGLNQYLVGSQLPCEPEPDVTVLTSMLTDPSHITAETAKRRLARGSPPS
LARSSASQLSAPSLKATCTTHHDSPDADLIEANLLWRQEMGNNITRVESENKVV
ILDSFDPLRAEEDEREVSVAAEILRKSRKFPPALPVWARPDYNPPLLESWKDPD
YVPPVVHGCPLPPTKAPPIPPPRRKRTVVLTESNVSSALAELATKTFGSSGSSA
VDSGTATAPPDQASDDGDKGSDVESYSSMPPLEGEPGDPDLEPEQVELQPPP
QGGEVAPGSDSGSWSTCSEEDDSWCCSMSYSWTGALITPCAAEESKLPINPL
SNSLLRHHNMVYATTSRSAGLRQKKVTFDRLQVLDDHYRDVLKEMKAKASTVK
```

-continued

AKLLSIEEACKLTPPHSAKSRYGFGAKEVRSLSRRAVNHIRSVWEDLLEDTETPI

DTTIMAKSEVFCVQPEKGGRKPARFIVFPDLGVRVCEKMALYDVVSTLPQAVM

GSSYGFQYSPKQRVEFLVNTWKSKKCPMGFSYDTRCFDSTVTENDIRVEESIY

QCCDLAPEARQAIKSLTERLYIGGPLTNSKGQSCGYRRCRASWLTTSCGNTLT

CYLKASAACRAAKLQDCTMLVNGDDLVVICESAGTQEDAASLRVFTEAMTRYS

APPGDPPKPEYDLELITSCSSNVSVAHDASGKRVYYLTRDPETPLARAAWETA

KHTPVNSWLGNIIMYAPTLWARMILMTHFFSILLAQEQLEKALDCQIYGACYSIE

PLDLPQIIERLHGLSAFSLHSYSPGEINRVASCLRKLGVPPLRAWRHRARSVRA

KLLSQGGRAANCGKYLFNWAVKTKLKLTPIPAASQLDLSSWFVAGYSGGDIYH

SLSRARPRWFMLCLLLLSVGVGIYLLPNR

Design32.mosaic5 Amino Acid Sequence
                                        SEQ ID NO: 53
MSTNPKPQRKTKRNTNRRPMDVKFPGGGQIVGGVYVLPRRGPRLGVRAARKT

SERSQPRGRRQPIPKARQPEGRAWAQPGYPWPLYANEGLGWAGWLLSPRGS

RPHWGPNDPRRRSRNLGKVIDTITCGFADLMGYIPLVGAPLGGAARALAHGVR

VLEDGVNYATGNLPGCSFSVFLLALLSCLTVPASAYQVRNSTGLYHVTNDCPN

SSIVYEAADAILHTPGCVPCVREGNASRCVVVAVTPTVATRDGKLPTTQLRRHID

LLVGSATLCSALYVGDLCGSVFLVGQLFTFSPRRHWTTQGCNCSIYPGHITGHR

MAWDMMMNWSPTAALVVAQLLRIPQAILDMIAGAHWGVLAGIAYFSMVGNWA

KVLVVLLLFAGVDAETHVTGGSAGHTTAGLVRLLSPGAKQNIQLINTNGSWHIN

RTALNCNESLNTGWLAGLFYHHKFNSSGCPERLASCRPLADFAQGWGPISYA

NGSGPDQRPYCWHYPPRPCGIVPAKSVCGPVYCFTPSPWVGTTDRSGAPTY

NWGENDTDVFVLNNTRPPLGNWFGCTWMNSTGFTKVCGAPPCVIGGVGNNT

LHCPTDCFRKHPEATYSRCGSGPWITPRCLVHYPYRLWHYPCTVNYTLFKVRM

YVGGVEHRLEAACNWTRGERCDLDDRDRSELSPLLLSTTQWQVLPCSFTTLP

ALTTGLIHLHQGIVDVQYLYGVGSSIASWAIKWEYVVLLFLLLADARVCSCLWM

MLLISQVEAALENLWLNAASLAGTHGLVSFLVFFCFAWYLKGRWVPGAAYALY

GMWPLLLLLLALPQRAYALDTEVAASCGGWLVGLMALTLSPYYKRYISWCLW

WLQYFLTRVEAQLHVWVPPLNVRGGRDAVILLMCWHPTLVFDITKLLLAVFGP

LWILQASLLKVPYFVRVQGLLRICALARKMAGGHYVQMAIIKLGALTGTYVYNHL

TPLRDWAHNGLRDLAVAVEPWFSQMETKLITWGADTAACGDIINGLPVSARR

GQEILLGPADGMVSKGWRLLAPITAYTQQTRGLLGCIITSLTGRDKNQVEGEVQI

VSTAAQTFLATCINGVCWTVYHGAGTRTIASPKGPVIQMYTNVDKDLVGWPAP

QGARSLTPCACGSSDLYLITRQADVIPARRRGDSRAALLSPRPISTLKGSSGGP

LLCPAGHAVGIFRAAVCTRGVAKAVDFIPVENLETTMRSPVYTDNSSPPAVPQS

FQVAHLHAPTGSGKSTKVPAAYASQGYKVLVLNPSVAATLSFGAYMSKAHGID

PNIRTGVRTITTGSPITYSTYGKFLADGGCSAGAYDIIICDECHSTDATSILGIGTV

LDQAETAGARLVVLAAATPPGSVTVPHSNIEEVALSTTGEIPFYGKAIPLEVIKGG

RHLIFCHSKKKCDELAAKLVALGINAVAYYRGLDVSVIPASGDVVVVATDALMTG

YTGDFDSVIDCNTSVIQTVDFSLDPTFTIETTTLPQDAVSRTQRRGRTGRGKPGI

-continued

YRFVAPGERPSGMFDSSILCECYDAGCAWYELTPAETTVRLRAYMNTPGLPVC

QDHLEFWEGVFTGLTRIDAHFLSQTKQSGENLPYLVAYQATVCARARAPPPSW

DSMWKCLIRLKPMLTGPTPLLYRLGAVQNEITLTHPVTKYIMTCMAADLEVVTST

VVVMVGGLLAALAAYCLSTGCVVIVGRIVLSGKPAIIPDREVLYREFDEMEECSQ

HLPYIEQGMMLAEQFKQKALGLLQTASRQAEVIAPAVQTNWQKLEAFWAKHM

WNFISGIQYLAGLSTLPGNPAIASLMAFTAAVTSPLTTSQTLLFNILGGVVVAAQL

AAPGAATAFVGAGLAGAAIGSVGLGKVLVDILTGYGAGVAGALVAFKIMSGEVP

STEDLVNLLPAILSPGALVVGVICAGILRRHVGPGEGAVQWMNRLIAFASRGNH

VSPAHYVPESDAAARVTAILSSLTVTQLLRRLHQWISSECTTPCSGSWLRDIWD

WICEVLSDFKTWLKAKLMPQLPGIPFVSCQRGYRGVWRGDGIMHTRCHCGAEI

TGHVKNGTMRIVGPRTCRNMWSGTFPINAYTTGPCTPLPAPNYTFALWRVSAE

EYVEIRQVGDFHYVTGMTTDNLKCPCQVPSPEFFTELDGVRLHRFAPPCKPLL

REEVSFRVGLHEYPVGSQLPCEPEPDVAVLTSMLTDPSHITAEAAGRRLARGS

PPSVASSSASQLSAPSLKATCTANHDSPDAELIEANLLWRQEVGGNITRVESEN

KVIVLDSFDPLVAEEDEREISVPAEILRKSRRFAPALPIWARPDYNPPLLETWKK

PDYEPPWHGCPLPPPQSPPVPPPRKKRTWLTESTVSTALAELATKSFGSSST

SGITGDNTTTSSEPAPSGCPPDSDAESYSSMPPLEGEPGDPDLSDGSWSTVS

SEAGTEDVVCCSMSYSWTGALVTPCAAEEQKLPINALSNSLLRHHNLVYSTTS

RSACQRQKKVTFDRLQVLDSHYQDVLKEVKAAASKVKANLLSVEEACSLTPPH

SARSKFGYGAKDVRCHARKAVNHINSVWKDLLEDSVTPIDTTIMAKNEVFCVDP

AKGGRKPARLIVFPDLGVRVCEKMALYDVVSKLPLAVMGSSYGFQYSPGQRVE

FLVQAWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAAGLQ

DCTMLVCGDDLVVIAESDGVEEDNRALRAFTEAMTRYSAPPGDPPQPEYDLELI

TSCSSNVSVAHDGAGKRVYYLTRDPTTPLARAAWETARHTPINSWLGNIIMFAP

TLWARMILMTHFFSVLIARDQLEQALDCEIYGACYSIEPLDLPPIIQRLHGLSAFS

LHGYSPVELNRVGACLRKLGVPPLRAWRHRARNVRARLLSRGGRAAICGKYLF

NWAVRTKLKLTPIAAAGQLDLSGWFTAGYSGGDIYHSVSHARPRWFWFCLLLL

AAGVGIYLLPNR

Design35-mosaic1-serial Amino Acid Sequence

SEQ ID NO: 54

MSTNPKPQRKTKRNTNRRPQDVKFPGGGQIVGGVYLLPRRGPRLGVRATRKT

SERSQPRGRRQPIPKARRPEGRTWAQPGYPWPLYGNEGCGWAGWLLSPRG

SRPSWGPTDPRRRSRNLGKVIDTLTCGFADLMGYIPLVGAPLGGAARALAHGV

RVLEDGVNYATGNLPGCSFSIFLLALLSCLTVPASAYQVRNSTGLYHVTNDCPN

SSIVYEAADAILHTPGCVPCVREGNASRCVVVALTPTLAARNSSIPTTTIRRHVDL

LVGAAAFCSAMYVGDLCGSVFLVSQLFTFSPRRHWTTQDCNCSIYPGHITGHR

MAWDMMMNWSPTTALVVSQLLRIPQAVVDMVAGAHWGVLAGLAYYSMVGN

WAKVLWLLLFAGVDAETRVTGGAAGHTAFGFASFLAPGAKQKIQLINTNGSW

HINRTALNCNDSLNTGFLAALFYVHKFNSSGCPERLASCRPLADFDQGWGPISY

-continued

```
ANGSGPDQRPYCWHYAPRPCGIVPASQVCGPVYCFTPSPWVGTTDRFGVPT
YSWGENETDVLLLNNTRPPQGNWFGCTWMNSTGFTKTCGGPPCNIGGVGNN
TLTCPTDCFRKHPEATYTKCGSGPWLTPRCLVDYPYRLWHYPCTVNFTIFKVR
MYVGGVEHRLEAACNWTRGERCDLEDRDRSELSPLLLSTTQWQVLPCSFTTL
PALSTGLIHLHQNIVDVQYLYGVGSSIASWAIKWEYVVLLFLLLADARVCACLWM
MLLIAQAEAALENLVVLNAASVAGAHGILSFLVFFCAAVVYIKGRLVPGAAYALYG
VWPLLLLLLALPPRAYAMDREMAASCGGWLVGLMALTLSPYYKRYISWCLWW
LQYFLTRVEAQLHVVVVPPLNVRGGRDAIILLTCVVHPTLVFDITKLLLAVFGPLWI
LQASLLKVPYFVRAQGLIRACMLVRKVAGGHYVQMAIIKLGALTGTYVYNHLTPL
RDWAHNGLRDLAVAVEPVVFSDMETKIITWGADTAACGDIINGLPVSARRGREI
LLGPADGMVSKGWRLLAPITAYAQQTRGLLGCIITSLTGRDKNQVEGEVQVVST
ATQSFLATCINGVCWTVYHGAGTRTIASPKGPVIQMYTNVDQDLVGWPAPQGA
RSLTPCTCGSSDLYLVTRHADVIPVRRRGDSRGSLLSPRPISYLKGSSGGPLLC
PAGHAVGIFRAAVCTRGVAKAVDFIPVESMETTMRSPVFTDNSSPPAVPQTFQ
VAHLHAPTGSGKSTKVPAAYAAQGYKVLVLNPSVAATLGFGAYMSKAHGIDPNI
RTGVRTITTGAPITYSTYGKFLADGGCSGGAYDIIICDECHSTDATSILGIGTVLD
QAETAGARLVVLATATPPGSVTVPHPNIEEVALSTTGEIPFYGKAIPLEVIKGGR
HLIFCHSKKKCDELAAKLVALGINAVAYYRGLDVSVIPTSGDVVVVATDALMTGY
TGDFDSVIDCNTCVTQTVDFSLDPTFTIETTTVPQDAVSRSQRRGRTGRGKPGI
YRFVTPGERPSGMFDSSVLCECYDAGCAWYELTPAETTVRLRAYLNTPGLPVC
QDHLEFWEGVFTGLTHIDAHFLSQTKQAGDNFPPYLVAYQATVCARAQAPPPS
WDQMWKCLIRLKPTLHGPTPLLYRLGAVQNEVTLTHPITKYIMTCMSADLEVVT
STVVVLVGGVLAALAAYCLTTGSVVIVGRIVLSGKPAIIPDREVLYREFDEMEECA
SHLPYIEQGMQLAEQFKQKALGLLQTATKQAEAAAPVVESKWRALEAFWAKH
MWNFISGIQYLAGLSTLPGNPAIASLMAFTAAVTSPLTTSQTLLFNILGGWVAAQ
LAPPSAASAFVGAGIAGAAVGSIGLGKVLVDILAGYGAGVAGALVAFKIMSGEVP
STEDLVNLLPAILSPGALWGVVCAAILRRHVGPGEGAVQWMNRLIAFASRGNH
VSPTHYVPESDAAARVTQILSSLTITQLLKRLHQWINEDCSTPCSGSWLRDVWD
WICTVLTDFKTWLQSKLLPRLPGVPFFSCQRGYKGVWRGDGIMHTRCHCGAEI
TGHVKNGSMRIVGPKTCSNTWHGTFPINAYTTGPCTPSPAPNYSRALWRVAAE
EYVEVTRVGDFHYVTGMTTDNLKCPCQVPSPEFFTELDGVRLHRFAPPCKPLL
REEVSFRVGLHEYPVGSQLPCEPEPDVAVLTSMLTDPSHITAETAKRRLARGSP
PSLASSSASQLSAPSLKATCTTHHDSPDADLIEANLLWRQEMGGNITRVESENK
WILDSFDPLVAEEDEREISVPAEILRKSRRFAPALPIWARPDYNPPLLESWKDP
DYVPPVVHGCPLPPTKAPPIPPPRRKRTVVLTESTVSSALAELATKSFGSSSTS
GITGDNTTTSSEPAPSGCPPDSDAESYSSMPPLEGEPGDPDLSDGWSTVSE
EASEDVVCCSMSYTWTGALITPCAAEESKLPINALSNSLLRHHNMVYATTSRSA
SQRQKKVTFDRLQVLDDHYRDVLKEMKAKASTVKAKLLSVEEACSLTPPHSAK
SKFGYGAKDVRCHARKAVNHINSVWKDLLEDSVTPIDTTIMAKNEVFCVQPEKG
GRKPARLIVFPDLGVRVCEKMALYDWSTLPQAVMGSSYGFQYSPGQRVEFLV
QAWKSKKTPMGFSYDTRCFDSTVTESDIRTEEAIYQCCDLDPQARVAIKSLTER
```

-continued

LYVGGPLTNSKGQNCGYRRCRASGVLTTSCGNTLTCYLKASAACRAAKLQDC

TMLVCGDDLVVICESAGTQEDAASLRAFTEAMTRYSAPPGDPPQPEYDLELITS

CSSNVSVAHDASGKRVYYLTRDPTTPLARAAWETARHTPVNSWLGNIIMYAPT

LWARMILMTHFFSILLAQEQLEKALDCQIYGACYSIEPLDLPPIIQRLHGLSAFSL

HSYSPGEINRVAACLRKLGVPPLRAWRHRARSVRAKLLSQGGRAATCGKYLFN

WAVRTKLKLTPIPAASQLDLSGWFVAGYSGGDIYHSLSRARPRWFMLCLLLLSV

GVGIYLLPNR*

Design35-mosaic2-serial Amino Acid Sequence
SEQ ID NO: 55
MSTLPKPQRKTKRNTNRRPMDVKFPGGGQIAGGVYLLPRRGPRLGVRAVRKT

SERSQPRGRRQPIPKARQPQGRHWAQPGYPWPLYGNEGCGWPGWLLSPRG

SRPHWGPNDPRRRSRNLGKVIDTITCGLADLMGYIPWGAPLGGVAAALAHGV

RAIEDGINYATGNLPGCSFSIFILALLSCLTTPASALTYGNSSGLYHLTNDCPNSS

IVLEADAMILHLPGCLPCVRVDNRSTCWHAVSPTLAIPNASTPATGFRRHVDLLA

GAAWCSSLYIGDLCGSLFLAGQLFTFQPRRHWTVQDCNCSIYTGHVTGHRMA

WDMMMNWSPTTTLVLSSILRVPEICASVIFGGHWGILLAVAYFGMAGNWLKVL

AVLFLFAGVEATTTTGHAVGRTTGGLVSIFSPGAKQNLQLINTNGSWHINRTAL

NCNDSLQTGFIASLFYTHKFNSSGCPERMAACKPLADFRQGWGQITYKVNISG

PSDDRPYCWHYAPRPCDWPARTVCGPVYCFTPSPVWGTTDRRGNPTYTW

GENETDVFMLESLRPPTGGWFGCTWMNSTGFTKTCGAPPCQIVPGDYNSSAN

ELLCPTDCFRKHPEATYQRCGSGPWVTPRCLVDYPYRLWHYPCTVNFTLHKV

RMFVGGIEHRFDAACNWTRGERCELHDRDRIEMSPLLFSTTQLAILPCSFSTMP

ALSTGLIHLHQNVVDVQYLYGVSSSVTSVVVVKWEYIVLMFLVLADARICTCLWL

MLLISNVEAAVERLVVLNAASAAGTAGWWWAVLFLCCVVVYVKGRLVPACTYM

ALGMWPLLLTILALPPRAYAMDNEQAASLGAVGLLVITIFTITPMYKKLLTCFIWW

NQYFLARAEAMVHEVVVPDLRVRGGRDSIILLTCLLHPQLGFEVTKILLAILAPLYI

LQYSLLKVPYFVRAHILLRACLLVRRLAGGKYVQACLLRLGAWTGTFVYDHLAP

LSDWASDGLRDLAVAVEPVIFSPMEKKVITWGADTAACGDILSGLPVSARLGNL

VLLGPADDMQRGGWKLLAPITAYAQQTRGLVGTIVTSLTGRDKNEVEGEIQVVS

TATQSFLATSINGVMWTVYHGAGSKTLAGPKGPVCQMYTNVDKDLVGWPSPP

GARSLTPCACGSSDLYLVTREADVIPARRRGDNRAALLSPRPISTLKGSSGGPI

MCPSGHVVGLFRAAVCTRGVAKSLDFIPVENMETTMRSPSFTDNSTPPAVPQT

YQVGYLHAPTGSGKSTRVPAAYASQGYKVLVLNPSVAATLSFGSYMRQAYGV

EPNVRTGVRTVTTGGAITYSTYGKFLADGGCSGGAYDVIICDECHSTDPTTVLGI

GTVLDQAETAGVRLTVLATATPPGSITVPHPNITETALPTTGEIPFYGKAIPLEYIK

GGRHLIFCHSKKKCDELAGKLKSLGLNAVAFYRGVDVSVIPTSGDVVVCATDAL

MTGYTGDFDSVIDCNVAVTQVVDFSLDPTFSIETTTVPQDAVARSQRRGRTGR

GKPGVYRFVSQGERPSGMFDTVVLCEAYDTGCAVVYELTPSETTVRLRAYMNT

PGLPVCQDHLEFWEAVFTGLTHIDAHFLSQTKQGGENFAYLVAYQATVCARAK

APPPSWDTMWKCLIRLKPTLTGPTPLLYRLGAVQNEIITTHPITKYIMTCMSADL

-continued

EVITSTVVVLVGGVVAALAAYCLSVGCVVICGRITLTGKPAVVPDREILYQQFDEM
EECSRHIPYLAEGQQIAEQFRQKVLGLLQASAKQAEELKPAVHSAWPKLEQFW
QKHLWNFVSGIQYLAGLSTLPGNPAVASLMSFSASLTSPLSTSTTLLLNILGGW
VASQLANPTASTAFVVSGLAGAAVGSIGLGRVLVDVLAGYGAGVSGALVAFKIM
SGECPTTEDMVNLLPALLSPGALWGWCAAILRRHVGPAEGANQWMNRLIAF
ASRGNHVSPTHYVPETDASKNVTQILTSLTITSLLRRLHQVVVNEDTATPCATSW
LRDVWDVVVCTVLSDFKVWLQAKLLPRLPGIPFLSCQTGYRGVWAGDGVCHTT
CTCGAVIAGHVKNGTMKITGPKTCSNTWHGTFPINATTTGPSTPRPAPNYQRAL
WRVSAEDYVEVRRLGDCHYVVGVTAEGLKCPCQVPAPEFFTEVDGVRIHRYA
PPCKPLLRDEVTFSVGLSNYAIGSQLPCEPEPDVTVVTSMLTDPTHITAETAARR
LKRGSPPSLASSSASQLSAPSLKATCTTSKDHPDMELIEANLLWRQEMGSNITR
VESENKVVVLDSFEPLTAEYDEREISVSAECHRPPRHKFPPALPIWARPDYNPP
LLQAWQMPGYEPPVVSGCAVAPPKPAPIPPPRRKRLVHLDESTVSHALAQLAD
KVFVESSNDPGPSSDSGLSITSPVPPAPSTPDDACSEAESYSSMPPLEGEPGD
PDLSSGSWSTVSDQDDWCCSMSYSWTGALITPCAAEEEKLPINPLSNSLIRHH
NMVYSTTSRSASLRQKKVTFDRVQVFDQHYQDVLKEIKLRASTVQAKLLSIEEA
CDLTPSHSARSKYGYGAQDVRSHASKAINHINSVWEDLLEDSDTPIPTTIMAKN
EVFCVDPSKGGRKPARLIVYPDLGVRVCEKMALYDVTRKLPQAVMGSAYGFQY
SPNQRVEYLLKMWRSKKVPMGFSYDTRCFDSTVTERDIRTENDIYQSCQLDPV
ARKAVSSLTERLYVGGPMVNSKGQSCGYRRCRASGVLPTSMGNTLTCYLKAQ
AACRAANIKDCDMLVCGDDLVVICESAGVQEDTASLRAFTDAMTRYSAPPGDA
PQPTYDLELITSCSSNVSVAHDGNGKRYYYLTRDCTTPLARAAWETARHTPVN
SWLGNIIMFAPTIWVRMVLMTHFFSILQSQEQLEKALDFDIYGVTYSVSPLDLPAI
IQRLHGMAAFSLHGYSPGELNRVGACLRKLGAPPLRAWRHRARAVRAKLIAQG
GKAAICGKYLFNWAVKTKLKLTPLVSASKLDLSGWFVAGYDGGDIYHSVSQAR
PRLLLLGLLLLTVGVGIFLLPAR

Design35-mosaic3-serial Amino Acid Sequence
                                           SEQ ID NO: 56
MSTNPKPQRITKRNINRRPQDVKFPGGGQIVGGVYLLPRRGPRLGVRTTRKTS

ERSQPRGRRQPIPKDRRSTGKSWGKPGYPWPLYGNEGLGWAGWLLSPRGS

RPTWGPTDPRHRSRNLGRVIDTITCGFADLMGYIPVVGAPVGGVARALAHGVR

VLEDGINYATGNLPGCSFSIFLLALLSCVTVPVSAVEVRNISSSYYATNDCSNNSI

TWQLTNAVLHLPGCVPCENDNGTLRCWIQVTPNVAVKHRGALTHNLRTHVDMI

VMAATVCSALYVGDVCGAVMIVSQALIVSPERHNFTQECNCSIYPGTITGHRMA

WDMMLNWSPTLTMILAYAARVPELVLEVVFGGHWGVMFGLAYFSMQGAWAK

VIAILLLVAGVDATTYSTGAQAGRGASGIANLFTPGAKQNIQLINTNGSWHINRTA

LNCNDSLKTGFIASLFYTHRFNSSGCPERLSSCRGLDDFRIGWGTLEYETNVTN

DEDMRPYCWHYPPKPCGIVSARTVCGPVYCFTPSPWVGTTDRQGVPTYSWG

ENETDVFLLNSTRPPRGAWFGCTWMNGTGFTKTCGAPPCRIRRDYNSTLDLL

CPTDCFRKHPDATYLKCGAGPWLTPKCLVEYPYRLWHYPCTINYTIFKIRMYVG

-continued

```
GVEHRLSAACNFTRGDRCRLEDRDRGQQSPLLHSTTEWAVLPCSFSDLPALST
GLLHLHQNIVDVQYMYGLSPALTKYIVRWEVVVVLLFLLLADARVCACLWMLIILG
QAEAALEKLIILHSASAASANGPLWFFIFFTAAWYLKGRVVPVATYSVLGLWSFL
LLVLALPQQAYALDAAEQGELGLVILVIISIFTLTPAYKILLSRSVWWLSYMLVLAE
AQIQQVVVPPLEARGGRDGIIWVAVILHPRLVFEVTKWLLAILGSAYLLKASLLRV
PYFVRAHALLRVCTLVRHLAGARYIQMLLITIGRWTGTYIYDHLSPLSTWAAQGL
RDLAVAVEPIIFSPMEKKVIVWGAETVACGDILHGLPVSARLGREVLLGPADGYT
SKGWKLLAPITAYTQQTRGLLGAIVVSMTGRDKTEQAGEIQVLSTVTQSFLGTSI
SGVLWTVYHGAGNKTLAGSRGPVTQMYSSAEGDLVGWPSPPGTKSLDPCTC
GAVDLYLVTRNADVIPVRRKDDRRGALLSPRPLSTLKGSSGGPVLCPRGHAVG
LFRAAVCSRGVAKSIDFIPVETLDIVTRSPTFSDNSTPPAVPQSYQVGYLHAPTG
SGKSTKVPVAYAAQGYKVLVLNPSVAATLGFGAYLSKAHGINPNIRTGVRTVTT
GDPITYSTYGKFIADGGCSAGAYDIIICDECHSVDATTILGIGTVLDQAETAGVRL
VVLATATPPGTVTTPHSNIEEVALGHEGEIPFYGRAIPLSYIKGGRHLIFCHSRKK
CDELAAALRGMGLNAVAYYRGLDVSVIPTQGDWWATDALMTGFTGDFDTVI
DCNVAVTQIVDFSLDPTFTITTQTVPQDAVSRSQRRGRTGRGRLGIYRYVSTGE
RASGMFDSWLCECYDAGAAWYELTPAETTVRLRAYFNTPGLPVCQDHLEFW
EAVFTGLTHIDAHFLSQTKQSGENFAYLTAYQATVCARAKAPPPSWDVMWKCL
TRLKPTLVGPTPLLYRLGSVTNEVTLTHPVTKYIATCMQADLEVMTSTWVLAGG
VLAAVAAYCLATGCVSIIGRLHINQRAVVAPDKEVLYEAFDEMEECASKAALIEE
GQRIAEMLKSKIQGLLQQASKQAQDIQPAVQASWPKVEQFWAKHMWNFHSGI
PYLARLSQLPGNPAVASMMAFSAALTSPLSTSTTILLNIMGGWLASQIAPPAGAT
GFVVSGLVGAAVGSIGLGKILVDVLAGYGAGISGALVAFKIMSGEKPSVEDVVNL
LPGILSPGALWGVICAAILRRHVGQGEGAVQWMNRLIAFASRGNHVAPTHYVT
ESDASQRVTQLLGSLTITSLLRRLHNWITEDCPIPCAGSWLRDVWDVVVCTILTD
FKNWLTSKLFPKMPGLPFISCQKGYRGVWAGTGIMTTRCPCGANISGNVRLGS
MRITGPKTCMNTWQGTFPINCYTEGPCVPKPPPNYKTAIWRVAASEYVEVTQH
GSFSYVTGLTSDNLKVPCQLPSPEFFSWVDGVQIHRFAPTPKPFFRDEVSFCV
GLNSFWGSQLPCDPEPDTEVLASMLTDPSHITAEAAARRLARGSPPSEASSSA
SQLSAPSLRATCTTHGKTYDVDMVDANLFMGGDVTRIESESKVWLDSLDSMT
EVEDDREPSVPSEYLIRRRKFPPALPPWARPDYNPPVIETWKRPGYEPPTVLG
CALPPTPQAPVPPPRRRRAKVLTQDNVEGVLREMADKVLSPLQDHNDSGHST
GADTGGDSVQQPSDETAASETGSLSSMPPLEGEPGDPDLEFEPARSAPPSEG
ECEVIDSDSKSWSTVSDQEDSVICCSMSYSWTGALITPCGPEEEKLPINPLSNS
LLRYHNKVYCTTSKSASLRAKKVTFDRVQVLDAHYDSVLKDIKLAASKVSARLLT
LEEACQLTPPHSARSKYGFGAKEVRSLSGRAVNHIKSVWKDLLEDSQTPIPTTI
MAKNEVFCVDPTKGGKKAARLIVYPDLSVRVCEKMALYDVTQKLPQAVMGASY
GFQYSPAQRVEFLLKAWAEKKDPMGFSYDTRCFDSTVTERDIRTEESIYQACS
LPQEARTVIHSLTERLYVGGPMFNSKGQTCGYRRCRASGVFTTSMGNTMTCYI
KALAACKAAGIVAPTMLVCGDDLVVISESQGNEEDERNLRAFTEAMTRYSAPP
```

-continued

GDLPRPEYDLELITSCSSNVSVALDSRGRRRYFLTRDPTTPITRAAWETVRHSP

VNSWLGNIIQYAPTIWVRMVIMTHFFSILLAQDTLNQNLNFEMYGAVYSVNPLDL

PAIIERLHGLDAFSLHTYSPHELSRVAATLRKLGAPPLRAWKSRARAVRASLIAQ

GGRAAICGRYLFNWAVKTKLKLTPLPEARLLDLSSWFTVGAGGGDIYHSVSRA

RPRLLLLCLLLLSVGVGIFLLPAR

Design35-mosaic4-serial Amino Acid Sequence
SEQ ID NO: 57
MSTNPKPQRKTQRNTNRRPTDVKFPGGGQIVGGVYLLPRRGPRLGVRATRKT

SERSQPRGRRQPIPKARRSEGRSWAQPGYPWPLYGNEGCGWAGWLLSPRG

SRPSWGPNDPRGRSRNLGKVIDTLTCGFADLMGYIPLVGAPVGSVARALAHGV

RAVEDGINYATGNLPGCSFSIFLLALLSCLTVPASAINYRNTSGIYHVTNDCPNS

SIVYEADHHILHLPGCVPCVREGNQSRCVVVALTPTVAAPYIGAPLESLRSHVDL

MVGAATVCSALYIGDLCGGLFLAGQMFSFRPRRHWTTQECNCSIYTGHITGHR

MAWDMMMSWSPTTTLVLSQVMRIPSTLVDLLAGGHWGVLVGVAYFSMQANW

AKVILVLFLFAGVDAETHVSGAAVGRSTAGLANLFSSGSKQNLQLINSNGSWHI

NRTSLNCNDSLNTGFLASLFYTHKFNSSGCSERLACCKSLDSYGQGWGPLGV

ANISGPSEDRPYCWHYPPRPCGIVPALSVCGPVYCFTPSPIVVGTTDRLGVPTY

TWGENESDVFLLNSTRPPQGAWFGCVWMNSTGFTKACGAPPCEVNTNNGTW

HCPTDCFRKHPETTYAKCGSGPWITPRCLIHYPYRLWHFPCTVNFTVFKVRTFI

GGIEHRMEAACNWTRGEVCGLEHRDRAELSPLLLSTTTWQILPCSFTTLPALST

GLIHLHQNTVDVQYLYGVGSAVVSWALKWEYVVLAFLLLADARVSACLWMMF

MVSQVEAALSNLININAASAAGNHGFVVYAIFFICIAWHVKGRLPAAATYVACGM

WPLLLLLLMLPERAYAFDREVAGSLGGAVVVALTILTLSPHYKSWLAKGLWWIQ

YFIARAEALLHVYVPSFDVRGPRDSLIILAVLACPHLTFDITKHLLAILGPLYILQAS

LLRIPYFVRAHALIKICSLLRGVVHGKYCQMVVLKMGALTGTYIYDHLTPLSDWA

AEGLRDLAVALEPVVFTAMEKKVIVWGADTAACGDIIRGLPVSARLGNEILLGPA

DSETSKGWRLLAPITAYAQQTRGLFSTIITSLTGRDTNENCGEVQVLSTATQSFL

GTAVNGVMWSVYHGAGSKTISGPKGPVNQMYTNVDQDLVGWPAPPGVKSLT

PCTCGASDLYLVTRHADWPVRRRGDTRGALLSPRPISILKGSSGGPLLCPMG

HAAGLFRAAVCTRGVAKAVDFVPVESLETTMRSPVFTDNSTPPAVPQTYQVAH

LHAPTGSGKSTKVPAAHAAQGYKVLVLNPSVAATLGFGAYMSKAYGIDPNIRSG

VRTITTGAPITYSTYGKFLADGGCAGGAYDIIICDECHSTDSTTILGIGTVLDQAET

AGVRLTVLATATPPGSVTTPHSNIEEVALPTTGEVPFYGKAIPLELIKGGRHLIFC

HSKKKCDELAKQLTSLGLNAVAYYRGLDVSVIPLSGDVWCATDALMTGFTGDF

DSVIDCNTSVIQTVDFSLDPTFSIEITTVPQDAVSRSQRRGRTGRGRLGIYRYVT

PGERPSGIFDTSVICECYDAGCAWYELTPAETTTRLRAYFNTPGLPVCQDHLEF

WESVFTGLTQIDGHFLSQTKQSGENFPYLVAYQATVCARALAPPPSWDTMWK

CLLRLKPTLRGPTPLLYRLGSVQNEVTLTHPITKYIMACMSADLEVVTSTVVVMV

GGLLAALAAYCLSVGSVVIVGRVVLSGQPAVIPDREVLYQQFDEMEECSKHLPL

VEHGLQLAEQFKQKAVGLLNFAGKQAQEATPVIQSNFAKLEQFWAKHMWNFIS

-continued

```
GIQYLAGLSTLPGNPAIASLMSFTAAVTSPLTTQQTLLFNILGGVVVASQIATPTAS

TAFVISGIAGAAVGSVGLGKILVDILAGYGAGVAGAVVTFKIMSGEMPSTEDLVN

LLPAILSPGALVVEVVCPAILRRHVGPGEGAVQWMNRLIAFASRGNHVAPTHYV

PESDAARRVTTILSSLTVTSLLRRLHKWINEDCSTPCAESWLWEVWDWVCTVL

SDFKTWLKAKLLPLMPGIPFLSCQRGYRGEWRGDGVMHTTCPCGAELAGHIK

NGSMRITGPKTCSNTWHGTFPINAYTTGPGVPVPAPNYKFALWRVSAEEYVEV

RRVGDFHYVTGVTQDNIKCPCQVPAPEFFTEVDGIRLHRHAPKCKPLLRDEVSF

SVGLNSFWGSQLPCEPEPDVAVLTSMLTDPSHITAESARRRLARGSRPSLASS

SASQLSPRLLQATCTAPHDSPGTDLLEANLLWGSTATRVETDEKVIILDSFEPRV

AESDDDREVSVAAEILRPTKKFPPALPIWARPDYNPPLTETWKQQDYKPPTVH

GCALPPSKQPPVPPPRRKRTVQLTESWSTALAELAAKTFGQSELGSDSGADL

TTPTETTDSGPILVDDASDDGSYSSMPPLEGEPGDPDLTSDSWSTVSGSEDVV

CCSMSYSWTGALVTPCAAEESKLPISPLSNSLLRHHNMVYATTTRSAVTRQKK

VTFDRLQVVDNHYNETLKEIKARASRVKARLLTTEEACDLTPPHSARSKFGYGA

KDVRSHSRKAINHINSVWEDLLEDNNTPIPTTIMAKNEVFAVNPAKGGRKPARLI

VYPDLGVRVCEKRALHDVINQLPKAVMGAAYGFQYSPAQRVEFLLTSWKSKKT

PMGFSYDTRCFDSTVTEKDIRTEEEVYQCCDLEPEARKVIAALTERLYVGGPMH

NSKGDLCGYRRCRASGVYTTSFGNTLTCYLKATAAIKAAGLRDCTMLVCGDDL

WIAESDGVEEDNRALRAFTEAMTRYSAPPGDAPQPAYDLELITSCSSNVSVAH

DATGKKVYYLTRDPETPLARAAWETVRHTPVNSWLGNIIVYAPTIVVVRMILMTH

FFSILQSQEALEKALDFDMYGVTYSITPLDLPAIIQRLHGLSAFTLHGYSPHELNR

VAGSLRKLGVPPLRAWRHRARAVRAKLIAQGGRAKICGIYLFNWAVKTKLKLTP

LPAAAKLDLSGWFTVGAGGGDIYHSMSHARPRYLLLCLLLLSVGVGIFLLPAR

Design35-mosaic5-serial Amino Acid Sequence
                                            SEQ ID NO: 58
MSTLPKPKRQTKRNTLRRPKNVKFPAGGQIVGEVYVLPRRGPKLGVRATRKNS

ERSQPRGRRQPIPKARRPTGRSWGQPGYPWPLYANEGLGWAGWLLSPRSSR

PNWGPNDPRRKSPNLGRVIHTLTCGFPHLMGYIPLVGGPVGGVARALAHGVR

ALEDGINFATGNLPGCSFSIFLLALFSCLIHPAASLEWRNTSGLYVLTNDCSNSSI

VYEADDVILHTPGCVPCVQDGNTSTCWTPVTPTVAVRYVGATTASIRSHVDLLV

GAATMCSALYVGDMCGAVFLVGQAFTFRPRRHQTVQTCNCSLYPGHLSGHR

MAWDMMMKWSPTTALLMAQLLRIPQVVIDIIAGAHWGILAGLAYYSMQGNWAK

VAIIMVMFSGVDAHTYTTGGTASRHTQAFAGLFDIGPQQKLQLVNTNGSWHINS

TALNCNESINTGFIAGLFYYHKFNSTGCPQRLSSCKPITFFKQGWGPLTDANITG

PSDDKPYCWHYPPRPCNITKPLNVCGPVYCFTPSPVWGTTDIKGLPTYRFGV

NESDVFLLTSLRPPQGRWFGCVWMNSTGFVKTCGAPPCNIYGGMKDIEANQT

HLKCPTDCFRKHPEATYSRCGAGPWLTPRCMVDYPYRLWHYPCTVNFTLFKV

RMFVGGFEHRFTAACNWTRGERCDIEDRDRSEQHPLLHSTTELAILPCSFTPM

PALSTGLIHLHQNIVDTQYLYGLSSSIVSWAVKWEYIMLVFLLLADARVCVALWL

MLMISQAEAALENLVTLNAVAAAGTHGIGVVYLVAFCAAWYVRGKLVPLVTYSLT
```

-continued

```
GLWSLALLVLLLPQRAYAWSGEDSATLGAGVLVLFGFFTLSPWYKHWIGRLIW
WNQYTICRCESALQVWVPPLLARGSRDGVILLTSLLYPSLIFDITKLLIAVLGPLYL
IQAALTSTPYFVRAHVLVRLCMLVRSVMGGKYFQMIILSIGRWFNTYLYDHLAP
MQHWAAAGLKDLAVATEPVIFSPMEIKVITWGADTAACGDILCGLPVSARLGRE
LLLGPADDYREMGWRLLAPITAHAQQTRGLFGTIVTSLTGRDKNWTGEVQVLS
TATQTFLGTTVGGVMWTVYHGAGSRTLAGAKHPALQMYTNVDQDLVGWPAP
PGAKSLEPCACGSADLYLVTRDADVIPARRRGDSTASLLSPRPLACLKGSSGG
PVMCPSGHVAGIFRAAVCTRGVAKALQFIPVETLSTQARSPSFSDNSTPPAVPH
EFQVGHLHAPTGSGKSTKVPAAYVAQGYNVLVLNPSVAATLGFGSFMSRAYGI
DPNIRTGNRTVTTGAKLTYSTYGKFFADGGCSGGAYDVIICDECHAQDATSILGI
GTVLDQAETAGVRLTVLATRTPPGSITVPHSNIEEVALGSEGEIPFYGKAIPIALL
KGGRHLIFCHSKKKCDEIASKLRGMGLNAVAYYRGLDVAVIPATGDVWCSTDA
LMTGFTGDFDSVIDCNVAVEQYVDFSLDPTFSIETRTAPQDAVSRSQRRGRTG
RGRHGIYRYVSSGERPSGIFDSVVLCECYDAGCSVVYDLQPAETTVRLRAYLST
PGLPVCQDHLDFWESVFTGLTHIDAHFLSQTKQQGLNFSYLTAYQATVCARAK
ASPPCWDEMWKCLVRLKPTLHGPTPLLYRLGPVQNETCLTHPITKYVMACMSA
DLEVTTSTWVLLGGVLAALAAYCLSVGCVVIVGHIELGGKPALVPDKEVLYQQY
DEMEECSQAAPYIEQAQAIAHQFKEKVLGLLQRATQQQAVIEPIVATNWQKLEA
FWHKHMWNFVSGIQYLAGLPTLPGNPAVASLMAFTASVTSPLTTNQTMFFNIL
GGVVVATHLAGPQSSSAFVVSGLAGAAIGGIGLGRVLLDILAGYGAGVSGALVAF
KIMCGERPTAEELVNLLPSILCPGALVVGVICAAVLRRHIGPGEGAVQWMNRLIA
FASRGNHGSPTHYVPESDAAAKVTALLSSLTVTRLLRRLHQWINEDYPSPCSD
DWLRIIWDVVVCSVLADFKTWLSAKIMPALPGLPFISCQKGYKGVWRGDGVMST
RCPCGATITGHVKNGSMRLAGPRTCANMWHGTFPINEYTTGPSTPCPSPNYT
RALWRVAANSYVEVRRVGDFHYITGATEDELKCPCQVPAAEFFTEVDGVRLHR
YAPPCKPLLRDDITFMVGLNSYAIGSQLPCEPEPDVTVLTSMLSDPAHITAETAK
RRLNRGSPPSLANSSASQLSAPSLKATCQTHRPHPDAELVDANLLWRQEMGS
NITRVESETKWILDSFEPLRAETDDAELSVAAECFKKPPKYPPALPIWARPDYN
PPLLDRWKAPDYVPPTVHGCALPPRGAPPVPPPRRKRTIQLDGSNVSAALAAL
AEKSFPSSKPQEENSSSSGVDTQSSTTSKVPPSPGGESDSESCSSMPPLEGE
PGDPDLSCDSWSTVSDSEEQSWCCSMSYSWTGALITPCSAEEEKLPISPLSN
SLLRHHNLVYSTSSRSASQRQRKVTFDRLQVLDDHYKTALKEVKERASRVKAR
MLTIEEACALVPPHSARSKFGYSAKDVRSLSSRAINQIRSVWEDLLEDTTTPIPT
TIMAKNEVFAVEPSKGGKKPARLIVYPDLGVRVCEKRALYDVIQKLSIATMGPAY
GFQYSPQQRVERLLKMWTSKKTPLGFSYDTRCFDSTVTEQDIRVEEEIYQCCN
LEPEARKVISSLTERLYCGGPMYNSKGQQCGYRRCRASGVLPTSFGNTITCYIK
ATAAAKAAGLRNPDFLVCGDDLVAICESQGTHEDEASLRAFTEAMTRYSAPPG
DPPVPAYDLELVTSCSSNVSVARDDKGRRYYYLTRDATTPLARAAWETAKHSP
VNSWLGNIIMYAPTIWVRMVMMTHFFSILQSQEILDRPLDFEMYGATYSVTPLDL
```

```
-continued
PAIIERLHGLSAFTLHSYSPVELNRVAGTLRKLGCPPLRAWRHRARAGRAKLIA

QGGKAKICGLYLFNWAVRTKTKLTPLPTAGQLDLSSWFTVGVGGNDIYHSVSR

ARTRHLLLCLLLLTVGVGIFLLPAR
```

LITERATURE CITATIONS

[1] Armstrong G L, Alter M J, McQuillan G M, Margolis H S. The past incidence of hepatitis C virus infection: implications for the future burden of chronic liver disease in the United States. Hepatology 2000; 31(3):777-82.

[2] Lauer G M, Walker B D. Hepatitis C virus infection. N Engl J Med 2001; 345(1):41-52.

[3] Wong J B, McQuillan G M, McHutchison J G, Poynard T. Estimating future hepatitis C morbidity, mortality, and costs in the United States. Am J Public Health 2000; 90(10):1562-9.

[4] Alter M J, Kruszon-Moran D, Nainan O V, McQuillan G M, Gao F, Moyer L A, et al. The prevalence of hepatitis C virus infection in the United States, 1988 through 1994. N Engl J Med 1999; 341(8):556-62.

[5] Conry-Cantilena C, VanRaden M, Gibble J, Melpolder J, Shakil A O, Viladomiu L, et al. Routes of infection, viremia, and liver disease in blood donors found to have hepatitis C virus infection. N Engl J Med 1996; 334(26):1691-6.

[6] Davis G L, Esteban-Mur R, Rustgi V, Hoefs J, Gordon S C, Trepo C, et al. Interferon alfa-2b alone or in combination with ribavirin for the treatment of relapse of chronic hepatitis C. International Hepatitis Interventional Therapy Group. N Engl J Med 1998; 339(21):1493-9.

[7] Fried M W, Shiffman M L, Reddy K R, Smith C, Marinos G, Goncales F L, Jr., et al. Peginterferon alfa-2a plus ribavirin for chronic hepatitis C virus infection. N Engl J Med 2002; 347(13):975-82.

[8] Manns M P, McHutchison J G, Gordon S C, Rustgi V K, Shiffman M, Reindollar R, et al. Peginterferon alfa-2b plus ribavirin compared with interferon alfa-2b plus ribavirin for initial treatment of chronic hepatitis C: a randomised trial. Lancet 2001; 358(9286):958-65.

[9] Zeuzem S, Feinman S V, Rasenack J, Heathcote E J, Lai M Y, Gane E, et al. Peginterferon alfa-2a in patients with chronic hepatitis C. N Engl J Med 2000; 343(23):1666-72.

[10] Cooper S, Erickson A L, Adams E J, Kansopon J, Weiner A J, Chien D Y, et al. Analysis of a successful immune response against hepatitis C virus. Immunity 1999; 10(4):439-49.

[11] Gerlach J T, Diepolder H M, Jung M C, Gruener N H, Schraut W W, Zachoval R, et al. Recurrence of hepatitis C virus after loss of virus-specific CD4(+) T-cell response in acute hepatitis C. Gastroenterology 1999; 117(4):933-41.

[12] Gerlach J T, Diepolder H M, Zachoval R, Gruener N H, Jung M C, Ulsenheimer A, et al. Acute hepatitis C: high rate of both spontaneous and treatment-induced viral clearance. Gastroenterology 2003; 125(1):80-8.

[13] Lechner F, Wong D K, Dunbar P R, Chapman R, Chung R T, Dohrenwend P, et al. Analysis of successful immune responses in persons infected with hepatitis C virus. J Exp Med 2000; 191(9):1499-512.

[14] Thimme R, Oldach D, Chang K M, Steiger C, Ray S C, Chisari F V. Determinants of viral clearance and persistence during acute hepatitis C virus infection. J Exp Med 2001; 194(10):1395-406.

[15] Shoukry N H, Grakoui A, Houghton M, Chien D Y, Ghrayeb J, Reimann K A, et al. Memory CD8+ T cells are required for protection from persistent hepatitis C virus infection. J Exp Med 2003; 197(12):1645-55.

[16] Mehta S H, Cox A, Hoover D R, Wang X H, Mao Q, Ray S, et al. Protection against persistence of hepatitis C. Lancet 2002; 359(9316):1478-83.

[17] Choo Q L, Kuo G, Weiner A J, Overby L R, Bradley D W, Houghton M. Isolation of a cDNA clone derived from a blood-borne non-A, non-B viral hepatitis genome. Science 1989; 244(4902):359-62.

[18] Bowen D G, Walker C M. Adaptive immune responses in acute and chronic hepatitis C virus infection. Nature 2005; 436(7053):946-52.

[19] Takaki A, Wiese M, Maertens G, Depla E, Seifert U, Liebetrau A, et al. Cellular immune responses persist and humoral responses decrease two decades after recovery from a single-source outbreak of hepatitis C. Nat Med 2000; 6(5):578-82.

[20] Kaplan D E, Sugimoto K, Newton K, Valiga M E, Ikeda F, Aytaman A, et al. Discordant role of CD4 T-cell response relative to neutralizing antibody and CD8 T-cell responses in acute hepatitis C. Gastroenterology 2007; 132(2):654-66.

[21] Cerny A, Chisari F V. Pathogenesis of chronic hepatitis C: immunological features of hepatic injury and viral persistence. Hepatology 1999; 30(3):595-601.

[22] Cucchiarini M, Kammer A R, Grabscheid B, Diepolder H M, Gerlach T J, Gruner N, et al. Vigorous peripheral blood cytotoxic T cell response during the acute phase of hepatitis C virus infection. Cell Immunol 2000; 203(2):111-23.

[23] Darling J M, Wright T L. Immune responses in hepatitis C: is virus or host the problem? Curr Opin Infect Dis 2004; 17(3):193-8.

[24] Erickson A L, Kimura Y, Igarashi S, Eichelberger J, Houghton M, Sidney J, et al. The outcome of hepatitis C virus infection is predicted by escape mutations in epitopes targeted by cytotoxic T lymphocytes. Immunity 2001; 15(6):883-95.

[25] Gruner N H, Gerlach T J, Jung M C, Diepolder H M, Schirren C A, Schraut W W, et al. Association of hepatitis C virus-specific CD8+ T cells with viral clearance in acute hepatitis C. J Infect Dis 2000; 181(5):1528-36.

[26] Ward S, Lauer G, Isba R, Walker B, Klenerman P. Cellular immune responses against hepatitis C virus: the evidence base 2002. Clin Exp Immunol 2002; 128(2):195-203.

[27] Bassett S E, Guerra B, Brasky K, Miskovsky E, Houghton M, Klimpel G R, et al. Protective immune response to hepatitis C virus in chimpanzees rechallenged following clearance of primary infection. Hepatology 2001; 33(6):1479-87.

[28] Major M E, Mihalik K, Puig M, Rehermann B, Nascimbeni M, Rice C M, et al. Previously infected and recovered chimpanzees exhibit rapid responses that control hepatitis C virus replication upon rechallenge. J Virol 2002; 76(13):6586-95.

[29] Nascimbeni M, Mizukoshi E, Bosmann M, Major M E, Mihalik K, Rice C M, et al. Kinetics of CD4+ and CD8+ memory T-cell responses during hepatitis C virus rechallenge of previously recovered chimpanzees. J Virol 2003; 77(8):4781-93.
[30] Houghton M, Abrignani S. Prospects for a vaccine against the hepatitis C virus. Nature 2005; 436(7053):961-6.
[31] Catanzaro A T, Koup R A, Roederer M, Bailer R T, Enama M E, Moodie Z, et al. Phase 1 safety and immunogenicity evaluation of a multiclade HIV-1 candidate vaccine delivered by a replication-defective recombinant adenovirus vector. J Infect Dis 2006; 194(12):1638-49.
[32] Fischer W, Perkins S, Theiler J, Bhattacharya T, Yusim K, Funkhouser R, et al. Polyvalent vaccines for optimal coverage of potential T-cell epitopes in global HIV-1 variants. Nat Med 2007; 13(1):100-6.
[33] Gaschen B, Taylor J, Yusim K, Foley B, Gao F, Lang D, et al. Diversity considerations in HIV-1 vaccine selection. Science 2002; 296(5577):2354-60.
[34] Doria-Rose N A, Learn G H, Rodrigo A G, Nickle D C, Li F, Mahalanabis M, et al. Human immunodeficiency virus type 1 subtype B ancestral envelope protein is functional and elicits neutralizing antibodies in rabbits similar to those elicited by a circulating subtype B envelope. J Virol 2005; 79(17):11214-24.
[35] Gao F, Weaver E A, Lu Z, Li Y, Liao H X, Ma B, et al. Antigenicity and immunogenicity of a synthetic human immunodeficiency virus type 1 group m consensus envelope glycoprotein. J Virol 2005; 79(2):1154-63.
[36] Fischer W, Liao H X, Haynes B F, Letvin N L, Korber B. Coping with viral diversity in HIV vaccine design: a response to Nickle et al. PLoS Comput Biol 2008; 4(1): e15; author reply e25.
[37] Kong W P, Wu L, Wallstrom T C, Fischer W, Yang Z Y, Ko S Y, et al. Expanded breadth of the T-cell response to mosaic human immunodeficiency virus type 1 envelope DNA vaccination. J Virol 2009; 83(5):2201-15.
[38] Thurmond J, Yoon H, Kuiken C, Yusim K, Perkins S, Theiler J, et al. Web-based design and evaluation of T-cell vaccine candidates. Bioinformatics 2008; 24(14):1639-40.
[39] Korber B T, MacInnes K, Smith R F, Myers G. Mutational trends in V3 loop protein sequences observed in different genetic lineages of human immunodeficiency virus type 1. J Virol 1994; 68(10):6730-44.
[40] Yusim K, Kesmir C, Gaschen B, Addo M M, Altfeld M, Brunak S, et al. Clustering patterns of cytotoxic T-lymphocyte epitopes in human immunodeficiency virus type 1 (HIV-1) proteins reveal imprints of immune evasion on HIV-1 global variation. J Virol 2002; 76(17):8757-68.
[41] Simmonds P. Genetic diversity and evolution of hepatitis C virus—15 years on. J Gen Virol 2004; 85(Pt 11):3173-88.
[42] Pawlotsky J M. The nature of interferon-alpha resistance in hepatitis C virus infection. Curr Opin Infect Dis 2003; 16(6):587-92.
[43] Zeuzem S. Heterogeneous virologic response rates to interferon-based therapy in patients with chronic hepatitis C: who responds less well? Ann Intern Med 2004; 140(5): 370-81.
[44] Letourneau S, Im E J, Mashishi T, Brereton C, Bridgeman A, Yang H, et al. Design and Pre-Clinical Evaluation of a Universal HIV-1 Vaccine. PLoS ONE 2007; 2(10): e984.
[45] Prince A M, Brotman B, Lee D H, Pfahler W, Tricoche N, Andrus L, et al. Protection against chronic hepatitis C virus infection after rechallenge with homologous, but not heterologous, genotypes in a chimpanzee model. J Infect Dis 2005; 192(10):1701-9.
[46] Farci P, Purcell R H. Clinical significance of hepatitis C virus genotypes and quasispecies. Semin Liver Dis 2000; 20(1):103-26.
[47] Harcourt G C, Lucas M, Godkin A J, Kantzanou M, Phillips R E, Klenerman P. Evidence for lack of cross-genotype protection of CD4+ T cell responses during chronic hepatitis C virus infection. Clin Exp Immunol 2003; 131(1):122-9.
[48] Hanke T, Schneider J, Gilbert S C, Hill A V, McMichael A. DNA multi-CTL epitope vaccines for HIV and *Plasmodium falciparum*: immunogenicity in mice. Vaccine 1998; 16(4):426-35.

SEQUENCE LISTING (58 sequences)

SEQ ID NO: 1 - protein, 3010 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARRPEGRTWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHITGHRMAWDMMMNWSPTTALVVSQLLRIPQAVVDMVAGAHWGVLAGLAYYSMVGNWAKVLIVMLLFAGVDGHTHVTGGRVASSTQSLVSWLSQGPSQKIQLVNTNGSWHINRTALNCNDSLQTGFLAALFYVHKFNSSGCPERMASCRPIDEFAQGWGPITHVVPNISDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALSTGLIHLHQNIVDVQYLYGIGSAVVSFAIKWEYVVLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLALLTLSPHYKVFLARLIWWLQYFITRAEAHLQVWVPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGREILLGPADSLEGQGWRLLAPITAYAQQTRGLLGCIITSLTGRDKNQVEGEVQVVSTATQSFLATCINGVCWTVYHGAGSKTLAGPKGPITQMYTNVDQDLVGWQAPPGARSLTPCTCGSSDLYLVTRHADVIPVRRRGDSRGSLLSPRPISYLKGSSGGPLLCPSGHAVGIFRAAVCTRGVAKAVDFIPVESMETTMRSPVFTDNSSPPAVPQTFQVAHLHAPTGSGKSTKVPAAYAAQGYKVLVLNPSVAATLGFGAYMSKAHGVDPNIRTGVRTITTGAPITYSTYGKFLADGGCSGGAYDIIICDECHSTDATSILGIGTVLDQAETAGARLVVLATATPPGSVTVPHPNIEEVALSTTGEIPFYGKAIPIETIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGKPGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVTSTWVLVGGVLAALAAYCLTTGSVVIVGRIILSGKPAIIPDREVLYREFDEMEECASHLPYIEQGMQLAEQFKQKALGLLQTATKQAEAAAPVVESKWRALEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAETAKRRLARGSPPSLASSSASQLSAPSLKATCTTHHDSPDADLIEANLLWRQEMGGNITRVESENKVVILDSFDPLRAEEDEREVSVPAEILRKSRKFPPALPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRCHARKAVNHINSVWKDLLEDTETPIDTTIMAKNEVFCVQPEKGGRKPARLIVFPDLGVRVCEKMALYDVVSTLPQAVMGSSYGFQYSPGQRVEFLVNAWKSKKTPMGFSYDTRCFDSTVTESDIRVEESIYQCCDLAPEARQAIRSLTERLYIGGPLTNSKGQNCGYRRCRASGVLTTSCGNTLTCYLKASAACRAAKLQDCTMLVCGDDLVVICESAGTQEDAASLRVFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRAKLLSQGGRAATCGKYLFNWAVRTKLKLTPIPAASQLDLSGWFVAGYSGGDIYHSLSRARPRWFMWCLLLLSVGVGIYLLPNR

SEQ ID NO: 2 - protein, 3011 aa, Artificial Sequence
  Recombinant polypeptide
MSTNPKPQRRTKRNTNRRPQDVKFPGGGQIVGGVYLLPRRGPRLGVRAPRKTSERSQPRGRRQPIPKARRPEGRTWAQPGYPWPLYGNEGMGWAGWLLSPRGSRPSWGPNDPRRRSRNLGRVIDTLTCGFADLMGYIPLVGAPLGGVARALAHGVRVLEDGVNYATGNLPGCSFSIFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAILDMIAGAHWGVLAGIAYFSMVGNWAKVLVVLLLFAGVDGHTHVTGGRVASSTQSLVSWLSQGPSQKIQLVNTNGSWHINRTALNCNDSLQTGFIAALFYAHRFNASGCPERMASCRPLADFDQGWGPISYANGSGPDQRPYCWHYPPKPCGIVPAKSVCGPVYCFTPSPVVVGTTDRSGAPTYNWGENDTDVFVLNNTRPPLGNWFGCTWMNSSGFTKVCGAPPCVIGGVGNNTLHCPTDCFRKHPEATYSRCGSGPWITPRCLVDYPYRLWHYPCTINYTIFKVRMYVGGVEHRLEAACNWTRGERCDLEDRDRSELSPLLLSTTEWQILPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDKDLVGWPAPQGARSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLSFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVIQTVDFSLDPTFTIETTTLPQDAVSRTQRRGRTGRGKPGIYRFVAPGERPSGMFDSSILCECYDAGCAWYELTPAETTVRLRAYMNTPGLPVCQDHLEFWEGVFTGLTHIDAHFLSQTKQSGENLPYLVAYQATVCARAQAPPPSWDQMWKCLTRLKPTLHGPTPLLYRLGAVQNEVTLTHPITKYIMTCMSADLEVATSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGVQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAVLRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGSNITRVESENKVVVLDSFDPLVAEEDEREISVPAEILRKSRRFAQALPVWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSGADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVYPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 3 - protein, 3010 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARQPEGRAWAQPGYPWPLYGNEGCGWAGWLLSPRGSRPSWGPTDPRRRSRNLGKVIDTLTCGLADLMGYIPLVGAPLGGAARALAHGVRVVEDGVNYATGNLPGCPFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHVSGHRMAWDMMMNWSPTTALVVSQLLRIPQAVVDMVAGAHWGVLAGLAYYSMVGNWAKVLIVMLLFAGVDGGTYVTGGTMAKNTLGITSLFSPGSSQKIQLINTNGSWHINSTALNCNDSLNTGFLAALFYTHRFNSSGCPERMASCRPIDKFAQGWGPITHVVPNISDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCMVDYPYRLWHYPCTVNFTIFKVRMYVGGVEHRLNAACNWTRGERCNLEDRDRSELSPLLLSTTQWQVLPCSFTTLPALTTGLIHLHQNVVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLVLLTLSPHYKVFLARLIWWLQYFITRAEAHLQVWIPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGKEILLGPADSLEGQGWRLLAPITAYSQQTRGLLGCIVTSLTGRDRNQVEGEVQVVSTATQSFLATCVNGVCWTVYHGAGSKTLAGPKGPITQMYTNVDQDLVGWQAPPGARSLTPCACGSSDLYLVTRHADVIPVRRRGDGRGSLLSPRPVSYLKGSSGGPLLCPSGHAVGIFRAAVCTRGVAKAVDFVPVESMETTMRSPVFTDNSSPPAVPQTFQVAHLHAPTGSGKSTRVPAAYAAQGYKVLVLNPSVAATLGFGAYMSKAHGIDPNIRTGVRTITTGAPITYSTYGKFLADGGCSGGAYDIIMCDECHSTDSTTILGIGTVLDQAETAGARLTVLATATPPGSVTVPHPNIEEVALSNTGEIPFYGKAIPIETIKGGRHLIFCHSRKKCDELAAKLSGLGLNAVAYYRGLDVSVIPASGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQALPPSWDQMWKCLIRLKPTLHGPTPLLYRLGAVQNEITLTHPITKYIMACMSADLEVVTSTWVLVGGVLAALAAYCLTTGSVVIVGRIILSGKPAVIPDREVLYQEFDEMEECASHLPYIEQGMQLAEQFKQKALGLLQTATKQAEAAAPVVESKWRALETFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVQESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVTVLTSMLTDPSHITAETAKRRLARGSPPSLASSSASQLSAPSLKATCTTRHDSPDADLIEANLLWRQEMGGNITRVESENKVVILDSFDPLRAEEDEREVSVPAEILRKSRKFPPALPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFVVQPEKGGRKPARLIVFPDLGVRVCEKMALYDVVSTLPQAVMGSSYGFQYSPKQRVEFLVNAWKSKKCPMGFAYDTRCFDSTVTENDIRVEESIYQCCDLAPEARQAIRSLTERLYIGGPLTNSKGQNCGYRRCRASGVLTTSCGNTLTCYLKASAACRAAKLQDCTMLVNGDDLVVICESAGTQEDAASLRVFTEAMTRYSAPPGDPPKPEYDLELITSCSSNVSVAHDASGKRVYYLTRDPTTPIARAAWETARSTPVNSWLGNIIMYAPTLWARMILMTHFFSILLAQEQLEKALDCQIYGACYSIEPLDLPQIIERLHGLSAFSLHSYSPGEINRVASCLRKLGVPPLRVWRHRARSVRAKLLSQGGRAATCGKYLFNWAVKTKLKLTPIPAASQLDLSGWFVAGYSGGDIYHSLSRARPRWFMWCLLLLSVGVGIYLLPNR

SEQ ID NO: 4 - protein, 3010 aa, Artificial Sequence
  Recombinant polypeptide
MSTNPKPQRQTKRNTNRRPQDVKFPGGGQIVGGVYLLPRRGPRLGVRAPRKTSERSQPRGRRQPIPKARRPEGRAWAQPGYPWPLYGNEGMGWAGWLLSPRGSRPSWGPNDPRRRSRNLGKVIDTLTCGFADLMGYIPLVGAPLGGAARVLAHGVRVLEDSVNYATGNLPGCSFSIFLLALLSCLTVPASAYQVRNSTGLYHVTNDCPNSSIVYEAADAILHTPGCVPCVREGNASRCWVAMTPTVATRDGKLPTTQLRRHIDLLVGSATLCSALYVGDLCGSVFLVGQLFTFSPRRHWTTQDCNCSIYPGHITGHRMAWDMMMNWSPTTALVVSQLLRIPQAVMDMVAGAHWGILAGLAYYSMVGNWAKVLVVLLLFAGVDAGTHVTGGSAAKDTSGFTSLFRIGARQNIQLINTNGSWHINRTALNCNASLDTGWVAGLFYYHKFNSSGCPERMASCRPLADFDQGWGPISYANGSGPDQRPYCWHYPPKPCGIVPAKSVCGPVYCFTPSPVVVGTTDRSGAPTYNWGENDTDVFVLNNTRPPLGNWFGCTWMNSSGFTKVCGAPPCVIGGVGNNTLHCPTDCFRKHPEATYSRCGSGPWITPRCLVDYPYRLWHYPCTINYTIFKVRMYVGGVEHRLEAACNWTRGERCDLEDRDRSELSPLLLSTTQWQVLPCSFTPMPALSTGLIHLHQNIVDVQYLYGVGSSIASWAIKWEYVVLLFLLLADARVCSCLWMMLLISQVEAALENLVILNAASLAGTHGLVSFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIVTSLTGRDKNQVEGEVQIVSTAAQTFLATCINGVCWTVYHGAGTRTIASPKGPVIQMYTNVDKDLVGWPAPQGARSLTPCACGSSDLYLVTRHADVIPVRRRGDSRGSLLSPRPVSYLKGSSGGPLLCPAGHAVGIFRAAVCTRGVAKAVDFIPVENLETTMRSPVFTDNSSPPVVPQSFQVAHLHAPTGSGKSTKVPAAYASQGYKVLVLNPSVAATLGFGAYMSKAHGIDPNIRTGVRTITTGASITYSTYGKFLADGGCSGGAYDIIICDECHSTDSTSILGIGTVLDQAETAGVRLTVLATATPPGSVTVPHSNIEEVALSTTGEIPFYGKAIPLEVIKGGRHLIFCHSKKKCDELAAKLVALGVNAVAYYRGLDVSVIPASGDVVVVATDALMTGYTGDFDSVIDCNTCVTQSVDFSLDPTFTIETTTLPQDAVSRTQRRGRTGRGKPGIYRFVAPGERPSGMFDSVVLCECYDAGCAWYELTPSETTVRLRAYMNTPGLPVCQDHLEFWESVFTGLTHIDAHFLSQTKQSGENFPYLVAYQATVCARAQALPPSWDQMWKCLVRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMALAEQFKQKALGLLQTASRQAEVIAPAVQTNWQKLEAFWAKHMWNFISGIQYLAGLSTLPGNPAIASLMAFTAAVTSPLTTSQTLLFNILGGWLAAQLAAPGAATAFVGAGLAGAAIGSVGLGKVLVDILAGYGAGVAGALVAFKVMSGDMPSTEDLVNLLPAILSPGALVVGVVCAAILRRHVGPGEGAVQWMNRLIAFASRGNHVSPTHYVPESDAAARVTTILSSLTVTQLLRRLHQWISSESTTPCSGSWLKDVWDWICTVLSDFKTWLQSKLLPRLPGVPFFSCQRGYKGVWRGDGIMHTTCPCGAQITGHVKNGSMRIVGPRTCSNTWHGTFPINAYTTGPCTPSPAPNYSRALWRVAAEEYVEVTRVGDFHYVTGMTTDNIKCPCQVPAPEFFTELDGVRLHRYAPACKPLLREEVTFQVGLNQYLVGSQLPCEPEPDVTVVTSMLTDPSHITAEAARRRLARGSPPSVASSSASQLSAPSLKATCTTHHDSPDADLIEANLLWRQEMGSNITRVESENKVVILDSFEPLRAEEDEREVSVAAEILRKSRKFPPALPVWARPDYNPPLIESWKDPDYVPPVVHGCPLPPTKAPPIPPPRRKKTVVLTESTVSSALAELATKTFGSSGSSAVDSGTATAPPDQPSDDGDAGSDVESYSSMPPLEGEPGDPDLSDGSWSTVSEEASEDVVCCSMSYSWTGALITPCAAEESKLPINALSNSLLRHHNMVYATTSRSASQRQKKVTFDRLQVLDNHYQDVLKEMKAKASTVKAKLLSVEEACKLTPPHSARSKFGYGAKDVRNLSSKAVNHIRSVWKDLLEDTETPIDTTIMAKSEVFCVQPEKGGRKPARFIVFPDLGVRVCEKMALYDVVSTLPQAVMGSSYGFQYSPKQRVEFLVNTWKSKKCPMGFSYDTRCFDSTVTESDIRVEESIYQCCDLAPEARQAIRSLTERLYIGGPLTNSKGQSCGYRRCRASGVLTTSCGNTLTCYLKASAACRAAKLQDCTMLVNGDDLVVICESAGTQEDAASLRVFTEAMTRYSAPPGDLPQPEYDLELITSCSSNVSVAHDATGKRVYYLTRDPTTPLARAAWETARHTPVNSWLGNIIMFAPTLWVRMILMTHFFSILLAQEQLEKALDCQIYGATYSIEPLDLPQIIQRLHGLSAFSLHSYSPGEINRVASCLRKLGVPPLRVWRHRARSVRAKLLSQGGRAAICGRYLFNWAVRTKLKLTPIPAASQLDLSGWFVAGYSGGDIYHSLSRARPRWFMWCLLLLSVGVGIYLLPNR

SEQ ID NO: 5 - protein, 3011 aa, Artificial Sequence
  Recombinant polypeptide
MSTNPKPQRKIKRNTNRRPQDVKFPGGGQIVGGVYLLPRRGPRLGVRTTRKTSERSQPRGRRQPIPKARRPEGRTWAQPGYPWPLYGNEGCGWAGWLLSPRGSRPSWGPSDPRRRSRNLGKVIDTLTCGFADLMGYIPLVGAPLGGAARALAHGVRVLEDGVNYATGNLPGCSFSIFLLALLSCLTIPASAYEVRNASGVYHVTNDCSNSSIVYEAADVIMHTPGCVPCVREGNSSRCWVALTPTLAARNSSIPTTTIRRHVDLLVGAAALCSAMYVGDLCGSVFLVSQLFTFSPRRYETVQDCNCSIYPGHVSGHRMAWDMMMNWSPTTALVVAQLLRIPQAILDMIAGAHWGVLAGIAYFSMVGNWAKVIVVLLLFAGVDGNTRVSGGEAAKNTMGFASLFVSGPSQKIQLINTNGSWHINRTALNCNDSLQTGFLAALFYAHKFNASGCPERMASCRPIDEFAQGWGPITHVVPNISDQRPYCWHYAPRPCGIVPASQVCGPVYCFTPSPVVVGTTDRSGVPTYTWGENETDVLILNNTRPPRGNWFGCTWMNSTGFTKTCGGPPCNIGGAGNNTLICPTDCFRKHPEATYARCGSGPWLTPRCMVDYPYRLWHYPCTVNYTLFKVRMYVGGVEHRLNAACNWTRGERCDLDDRDRSELSPLLLSTTEWQILPCSFTTLPALTTGLIHLHQNIVDVQYLYGVGSSIVSWAIKWEYVILLFLLLADARICSCLWMMLLISQAEAALENLVLLNAASLAGVHGILSFLVFFCAAWYIKGRLVPGAAYAFYGVWPLLLLLMALPARAYAMDREMAASCGGAVFVGLVLLTLSPYYKVFLAKLIWWLQYLITRAEAHLQVWVPPLNVRGGRDAIILLTCAVHPELIFDITKLLLAILGPLMVLQAGITRVPYFVRAQGLIRACMLVRKAAGGHYVQMAFMKLAALTGTYVYDHLTPLQDWAHTGLRDLAVAVEPVIFSDMETKIITWGADTAACGDIISGLPVSARRGKEILLGPADSFGEQGWRLLAPITAYSQQTRGLLGCIITSLTGRDKNQVEGEVQMVSTATQSFLATCINGACWTVYHGAGSKTLAGPKGPITQMYTNVDQDLVGWPAPPGARSMTPCTCGSSDLYLVTRHADVIPVRRRGDTRGSLLSPRPISYLKGSSGGPLLCPSGHVVGIFRAAVCTRGVAKAVDFIPVESLETTMRSPVFTDNSSPPAVPQSFQVAYLHAPTGSGKSTKVPAAYAAQGYTVLVLNPSVAATLSFGAYMSKAHGVDPNIRTGVRTITTGSPITYSTYGKFLADGGCSGGAYDIIMCDECHSTDATSILGIGTALDQAETAGARLVVLATATPPGSITVPHPNIEEVALSNTGEIPFYGKAIPLEAIKGGRHLIFCHSKRKCDELAAKLVALGINAVAYYRGLDVSVIPTSGNVVVVATDALMTGFTGDFDSVIDCNTCVTQTVDFSLDPTFTIETTTVPQDAVSRTQRRGRTGRGRRGIYRFVTPGERPSGMFDSSVLCECYDAGCAWYELTPAETSVRLRAYLNTPGLPVCQDHLEFWEGVFTGLTRIDAHFLSQTKQAGDNFPYLVAYQATVCARSQAPPPSWDQMWKCLIRLKPTLHGATPLLYRLGAVQNEITLTHPITKYIMACMSADLEVVTSTWVLVGGVLAALAAYCLTTGCVVIVGRVVLSGKPAIVPDREVLYRQFDEMEECSQHLPYIEQGMMLAEQFKQKALGLLQTATKQAEAAAPMVESKWRALETFWAKHMWNFISGVQYLAGLSTLPGNPAIASLMAFTASVTSPLTTQSTLLFNILGGWVAAQLAPPSAASAFVGAGIAGAAVGSIGLGKVLVDVLAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLMPRLPGVPFLSCQRGYKGVWRGDGIMQTTCPCGAQIAGHVKNGSMRIVGPKTCSNTWHGTFPINAYTTGPCTPLPAPNYKFALWRVSAEEYVEVRQVGDFHYVTGMTTDNVKCPCQVPAPEFFTEVDGVRLHRYAPPCKPLLRDEVTFQVGLNQYVVGSQLPCEPEPDVTVLTSMLTDPSHITAETAKRRLARGSPPSLASSSASQLSAPSLKATCTTRHDSPDADLIEANLLWRQAMGGNITRVESENKVVVLDSFDPLRAEEDEREVSVPAEILRRSRKFPPAMPIWARPDYNPPLLESWKDPDYVPPVVHGCPLPPAKAPPIPPPRRKRTVVLTESSVSSALAELATKTFGSSESSAVDSGTATGPPDQASDDGDKGSDVESYSSMPPLEGEPGDPDFSDGSWSTVSSGADTEDVVCCSMSYTWTGALITPCAAEESKLPINPLSNSLLRHHSMVYSTTSRSASLRQKKVTFDRLQVLDDHYRDVLKEMKAKASTVKAKLLSIEEACKLTPPHSAKSKFGYGAKDVRSLSSRAVNHIRSVWEDLLEDTETPIDTTVMAKNEVFCIQPEKGGRKPARLIVYPDLGVRVCEKMALYDVVSTLPQAVMGPSYGFQYSPGQRVEFLVNAWKSKKNPMGFAYDTRCFDSTVTENDIRVEESIYQCCDLAPEARQAIKSLTERLYIGGPLTNSKGQNCGYRRCRASGVLTTSCGNTLTCYIKAQAACRAAGLRDCTMLVCGDDLVVICESQGVQEDAANLRAFTEAMTRYSAPPGDPPQPEYDLELITSCSSNVSVAHDGAGKRVYYLTRDPTTPLARAAWETARHTPINSWLGNIIMFAPTLWARMILMTHFFSVLIARDQLEQALDCEIYGACYSIEPLDLPPIIQRLHGLSAFSLHSYSPGEINRVATCLRKLGVPPLRAWRHRARNVRARLLSRGGRAAICGKYLFNWAVKTKLKLTPIAAAGQLDLSGWFTAGYSGGDIYHSVSRARPRWFWFCLLLLAAGVGIYLLPNR

SEQ ID NO: 6 - protein, 3011 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGLADLMGYIPLVGAPLGGVARALAHGVRVVEDGVNYATGNLPGCSFSIFLLALLSCLTTPASAYEVRNVSGVYHVTNDCSNASIVYEAADMIMHTPGCVPCVRENNSSRCWVALTPTLAARNASVPTTTIRRHVDLLVGAAAFCSAMYVGDLCGSVFLISQLFTFSPRRHETVQDCNCSIYPGHVTGHRMAWDMMMNWSPTAALVVSQLLRIPQAVVDMVAGAHWGVLAGLAYYSMAGNWAKVLIVMLLFAGVDGGTYVTGGTMAKNTLGITSLFSPGSSQKIQLVNTNGSWHINSTALNCNDSLNTGFLAALFYTHRFNSSGCPERLASCRPLTDFAQGWGPITYAGSRSPDQRPYCWHYAPQPCGIVPAAQVCGPVYCFTPSPVVVGTTDRFGVPTYSWGENETDVLLLNNTRPPQGNWFGCTWMNGTGFTKTCGAPPCNIGGVGNNTLTCPTDCFRKHPEATYTKCGSGPWLTPRCLVHYPYRLWHYPCTVNFTIFKVRMYVGGVEHRLDAACNWTRGERCNLEDRDRSELSPLLLSTTEWQVLPCSFTTLPALSTGLIHLHRNIVDVQYLYGIGSAVVSFAIKWEYVLLLFLLLADARVCACLWMMLLIAQAEAALENLVVLNAASVAGAHGILSFLVFFCAAWYIKGKLVPGAAYALYGVWPLLLLLLALPPRAYAMDREVAASCGGAVFIGLALLTLSPHYKVFLARLIWWLQYFITRAEAHLQVWIPPLNVRGGRDAIILLTCAIHPELIFTITKILLAILGPLMVLQAGLTRVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGKEIFLGPADSLEGQGWRLLAPITAYSQQTRGLFGCIITSLTGRDRNQVEGEVQVVSTATQSFLATCVNGVCWTVFHGAGSKTLAGPKGPIIQMYTNVDQDLVGWQAPPGARSLTPCTCGSSDLYLVTRHADVIPVRRRGDGRGSLLSPRPVSYLKGSSGGPLLCPSGHAVGIFRAAVCTRGVAKAVDFVPVESMETTMRSPVFTDNSSPPAVPQTFQVAHLHAPTGSGKSTRVPAAYAAQGYKVLVLNPSVAATLGFGAYMSKAYGTDPNIRTGVRTITTGAPITYSTYGKFLADGGCSGGAYDIIICDECHSTDSTTILGIGTVLDQAETAGARLTVLATATPPGSVTVPHPNIEEVALSNIGEIPFYGKAIPIETIKGGRHLIFCHSRKKCDELAAKLSGLGLNAVAYYRGLDVSVIPTSGDVVVVATDALMTGYTGDFDSVIDCNTCVIQTVDFSLDPTFTIDTTTVPQDAVSRSQRRGRTGRGRGGIYRFVTPGERPSGMFDSSILCECYDAGCAWYELTPAETTVRLRAYLNTPGLPVCQDHLEFWEGVFTGLTHIDAHFLSQTKQSGENLPYLVAYQATVCARAQAPPPSWDQMWKCLTRLKPTLHGPTPLLYRLGAVQNEVTLTHPITKFIMACMSADLEVVTSTWVLVGGVLAALAAYCLTTGSVVIVGRIILSGKPAVIPDREVLYQEFDEMEECASHLPYIEQGMQLAEQFKQKALGLLQTASKQAEAAAPVVESKWRALEAFWAKHMWNFISGIQYLAGLSTLPGNPAIVSLMAFTASITSPLTTQHTLLFNILGGWVAAQLAAPGAATAFVGAGLAGAAVGSVGLGKVLVDIIAGYGAGVAGALVAFKIMSGEVPSTEDLVNLLPAILSPGALVVGVVCAAVLRRHVGPGEGAVQWMNRLIAFASRGNHVSPTHYVQESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPSTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLNDGSWSTVSSEAGTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSARSKYGYGAKDVRCHARKAVNHINSVWKDLLEDSVTPIDTTIMAKNEVFCVQPERGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPKPEYDLELITSCSSNVSVAHDASGKRVYYLTRDPTTPLGRAAWETVRHTPVNSWLGNIIMYAPTLWARMVLMTHFFSILIAQEQLEKALDCQIYGACYSIEPLDLPQIIERLHGLSAFTLHSYSPGEINRVAACLRKLGVPPLRAWRHRARSVRARLLSQGGRAATCGKYLFNWAVRTKLKLTPIPAASRLDLSGWFTAGYSGGDIYHSVSHARPRWFMLCLLLLSVGVGVYLLPNR

SEQ ID NO: 7 - protein, 3011 aa, Artificial Sequence
  Recombinant polypeptide
MSTNPKPQRKTKRNTNRRPQDVKFPGGGQIVGGVYLLPRRGPRLGVRAPRKTSERSQPRGRRQPIPKARRPEGRTWAQPGFPWPLYGNEGCGWAGWLLSPRGSRPSWGPSDPRRRSRNLGKVIDTLTCGFADLMGYIPLVGAPLGGAARVLAHGVRVLEDGVNYATGNLPGCPFSIFLLALLSCLTIPASAYEVRNASGVYHVTNDCPNSSIVYETADMIMHTPGCVPCVREGNSSRCWVALTPTLAARNSSIPTTTIRRHVDLLVGTAAFCSAMYVGDLCGSVFLVSQLFTFSPRHHWTTQGCNCSIYPGHVSGHRMAWDMMMNWSPTAALVVAQLLRIPQAILDMIAGAHWGVLAGMAYFSMVGNWAKVLIVMLLFAGVDGHTHVTGGRVASSTQSLVSWLSQGPSQKIQLVNTNGSWHINRTALNCNDSLQTGFIAALFYAHRFNASGCPERMASCRPIDKFAQGWGPITHVVPNISDQRPYCWHYAPQPCGIVPASEVCGPVYCFTPSPVVVGTTDRFGVPTYSWGENETDVLLLNNTRPPQGNWFGCTWMNSTGFTKTCGGPPCNIGGVGNNTLICPTDCFRKHPEATYTKCGSGPWLTPRCLVDYPYRLWHYPCTVNFTVFKVRMYVGGVEHRLNAACNWTRGERCDLEDRDRSELSPLLLSTTEWQILPCSFTTLPALSTGLIHLHQNIVDIQYLYGIGSAAVSFAIKWEYVLLLFLLLADARVCACLWMMLLIAQAEAALENLVVLNAASLAGAHGVFSFLVFFCAAWYIKGRLVPGAAYALYGVWPLLLLLLALPPRAYAMDREMAASCGGAVFIGLALLTLSPHYKVFLARLIWWLQYFITRAEAHLQVWVPPLNVRGGRDAIILLACAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVIFSDMETKIITWGADTAACGDIISGLPVSARRGKEILLGPADSFGEQGWRLLAPITAYAQQTRGLLGCIVTSLTGRDKNQVDGEVQVLSTATQSFLATCVNGVCWTVFHGAGSKTLAGPKGPITQMYTNVDQDLVGWPAPPGARSMTPCTCGSSDLYLVTRHADVVPVRRRGDSRGSLLSPRPVSYLKGSSGGPLLCPSGHVVGIFRAAVCTRGVAKAVDFIPVESMETTMRSPIFTDNSSPPAVPQTFQVAHLHAPTGSGKSTKVPAAYAAQGYKVLVLNPSVAATLSFGAYMSKAHGTDPNIRTGVRTITTGAPITYSTYGKFLADGGCSGGAYDIIMCDECHSTDSTTILGIGTVLDQAETAGARLVVLATATPPGSITVPHPNIEEVALSNTGEIPFYGKAIPLEAIKGGRHLIFCHSRKKCDELAAKLVALGVNAVAYYRGLDVSVIPTSGDVVVVATDALMTGYTGDFDSVIDCNTCVTQTVDFSLDPTFTIDTTTVPQDAVSRSQRRGRTGRGRMGIYRFVTPGERPSGMFDSSVLCECYDAGCAWYELTPAETTVRLRAYLNTPGLPVCQDHLEFWEGVFTGLTRIDAHFLSQTKQSGENFPYLVAYQATVCARAQALPPSWDQMWKCLTRLKPTLHGPTPLLYRLGAVQNEITLTHPITKYIMTCMAADLEVVTSTWVLVGGVLAALAAYCLTTGSVVIVGRIILSGRPAVVPDREVLYQQFDEMEECASHLPYIEQGMQLAEQFKQKALGLLQTATKQAEAAAPMVESKWRALETFWAKHMWNFISGIQYLAGLSTLPGNPAIASLMAFTASITSPLTTQSTLLFNILGGWVAAQLAAPGAATAFVGAGLAGAAVGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVQESDAAARVTAILSSLTVTQLLRRLHQWISSDCTTPCSDSWLRDIWDWICEVLSDFKTWLKAKLMPQLPGIPFVSCQRGYRGAWRGDGIMHTRCHCGAEITGHVKNGTMRIVGPRTCRNMWSGTFPINAYTTGPCTPLPAPNYTFALWRVSAEEYVEIRRVGDFHYVTGMTTDNLKCPCQVPSPEFFTELDGVRLHRYAPPCKPLLREEVSFRVGLHEYPVGSQLPCEPEPDVAVLTSMLTDPSHITAEAAKRRLARGSPPSEASSSASQLSAPSLKATCTANHDSPDAELIEANLLWRQEMGGDITRVESKNKVVILDSFDPLVAEEDEREISVPAEILRKSRRFAQALPVWARPDYNPPLVETWKKPDYEPPVVHGCPLPPAKAPPIPPPRRKRTVVLTESTVSTALAELATKSFGSSSTSGITGDNTTTSSEPASSGCPPDSDAESYSSMPPLEGEPGDPDLNDGSWSTVSSEAGTEDVVCCSMSYSWTGALITPCAAEETKLPINALSNSLLRHHNLVYSTTSRSACLRQKKVTFDRLQVLDNHYQDVLKEVKAAASKVKANLLSVEEACSLTPPHSARSKFGYGAKDVRCHARKAVNHINSVWKDLLEDSVTPIDTTIMAKNEVFCVQPEKGGRKPARLIVYPDLGVRVCEKMALYDVVSKLPLAVMGSSYGFQYSPGQRVEFLVKAWKSKKNPMGFAYDTRCFDSTVTENDIRTEESIYQCCDLAPEARQVIRSLTERLYIGGPLTNSKGQNCGYRRCRASGVLTTNCGNTLTCYIKAQAACRAAGLRDCTMLVCGDDLVVICESQGVQEDAANLRAFTEAMTRYSAPPGDLPQPEYDLELITSCSSNVSVAHDGAGKRVYYLTRDPATPFARAAWETAKHTPVNSWLGNIIMFAPTLWVRMILLTHFFSVLIARDQLEQALNCEIYGACYSIEPLDLPPIIQRLHGLSAFSLHSYSPGEINRVASCLRKLGVPPLRVWRHRARSVRARLLSQGGRAATCGKYLFNWAVKTKLKLTPIPAASRLDLSGWFVAGYSGGDIYHSVSRARPRWFMLCLLLLSVGVGVYLLPNR

SEQ ID NO: 8 - protein, 3011 aa, Artificial Sequence
  Recombinant polypeptide
MSTNPKPQRQTKRNTNRRPQDVKFPGGGQIVGGVYLLPRRGPRLGVRATRKTSERPQPRGRRQPIPKARQPEGRAWAQPGHPWPLYGNEGMGWAGWLLSPRGSRPSWGPNDPRRRSRNLGKVIDTLTCGLADLMGYIPLVGAPLGGVARALAHGVRVVEDGVNYATGNLPGCSFSIFLLALLSCLTIPASAYQVRNSTGLYHVTNDCSNSSIVYEAADVIMHTPGCVPCVREDNSSRCWVALTPTLAARNASIPTTAIRRHVDLLVGAAAFCSAMYVGDLCGSVFLISQLFTFSPRRYETVQDCNCSLYPGHVSGHRMAWDMIMNWSPTTALVVSQLLRIPQAVVDMVAGAHWGVLAGLAYYSMVGNWAKVLVVMLLFAGVDGGTHVTGGKVAYTTQGFTSFFSRGPSQKIQLVNTNGSWHINRTALNCNDSLNTGFLAALFYAHKFNSSGCSGRMASCRPIDEFAQGWGPITYAEPHDLDQRPYCWHYAPRPCGIVPASTVCGPVYCFTPSPVVVGTTDKSGAPTYNWGENDTDVFVLNNTRPPRGNWFGCTWMNSTGFTKVCGAPPCVIGGVGNNTLRCPTDCFRKHPEATYARCGSGPWLTPRCLVHYPYRLWHYPCTINYTIFKVRMYVGGVEHRLEAACNWTRGERCDLTDRDRSELSPLLLSTTEWQVLPCSFTTLPALSTGLIHLHRNIVDVQYLYGIGSAVVSFAIKWEYILLLFLLLADARFCACLWMMLLVAQAEAALENLVVLNAASVAGAHGILSFLVFFCAAWYIKGKLVPGAAYAFYGVWPLLLLLMALPARAYAMDREMAASCGGAVFVGLVLLTLSPYYKVFLAKLIWWLQYLITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLQDWAHAGLRDLAVAVEPVVFSRMETKLITWGADTAACGDILSGLPVSARRGKEIFLGPADSLEGQGWRLLAPITAYSQQTRGLLGCIITSLTGRDKNQVEGEVQIVSTATQTFLATCVNGVCWTVYHGAGTRTIASSKGPVIQMYTNVDQDLVGWPAPQGSRSLTPCTCGSSDLYLVTRHADVIPVRRRGDNRGSLLSPRPISYLKGSSGGPLLCPSGHAAGIFRAAVCTRGVAKAVDFVPVESMETTMRSPVFTDNSTPPAVPQSFQVTHLHAPTGSGKSTRVPAAYAAQGYKVLVLNPSVAATLGFGVYMSKAHGVDPNVRTGVRTITTGSPITYSTYGKFLADGGCSGGAYDIIMCDECHSTDSTSILGIGTVLDQAETAGVRLTVLATATPPGSVTVPHPNIEEVALSNIGEIPFYGKAIPIEAIKGGRHLIFCHSKKKCDELAAKLSALGLNAVAYYRGLDVSVIPSSGDVVVVATDALMTGFTGDFDSVIDCNTCVIQTVDFSLDPTFTIETTTVPQDAVSRTQRRGRTGRGRGGIYRFVTPGERPSGMFDSSVLCECYDAGCAWYELTPAVTSVRLRAYLNTPGLPVCQVHLEFWESVFTGLTHIDAHFLSQTKQAGENFPYLTAYQATVCARAQAPPPSWDQMWKCLNRLKPTLHGPTPLLYRLGAVQNEVTLTHPITKFIMACMSADLEVVTSTWVLVGGVLAALAAYCLSTGCVVIVGRIILSGKPAVIPDREVLYREFDEMEECASQLPYIEQGMQLAEQFKQKAIGLLQTATKQAEAAAPVVESKWRALEAFWAKHMWNFISGIQYLAGLSTLPGNPAIVSLMAFTASITSPLTTQHTLLFNILGGWVAAQLAPPRAASAFVGAGIAGAAVGSIGLGKVLVDILAGYGAGVAGALVAFKVMSGDMPSTEDLVNLLPAILSPGALVVGVVCAAILRRHVGPGEGAVQWMNRLIAFASRGNHVSPTHYVPESDAAARVTQILSNLTITQLLKRLHQWINEDCSTPCSGSWLRDVWDWICTVLADFKTWLQSKVLPRLPGVPFFSCQRGYKGVWRGDGIMYTTCPCGAQITGHVKNGTMRIVGPKTCRNMWSGTFPINAYTTGPCTPLPAPNYKFALWRVSAEEYVEIRQVGDFHYVTGMTADNLKCPCQVPAPEFFTELDGVRLHRFAPPCKPLLRDEVSFRVGLHDYPVGSQLPCEPEPDVAVVTSMLTDPSHITAEAAGRRLARGSPPSVASSSASQLSAPSLKATCTTNHDSPDAELIEANLLWRQEMGGNITRVESENKVVVLDSFDPLVAEEDEREVSIPAEILRKSRKFPRAMPIWARPDYNPPLIESWKDPDYVPPVVHGCPLPPPRSPPVPPPRKKRTVVLTESTLSTALAELATKSFGSSSTSGITGDDTTTSSEPAPSGCPPDSDAESCSSMPPLEGEPGDPDFSDGSWSTVSSGADTEDVVCCSMSYSWTGALVTPCAAEEQKLPINALSNSLLRHHNMVYSTTSRSACQRQKKVTFDRLQVLDSHYQDVLKEVKAAASTVKANLLSVEEACSLTPPHSAKSKFGYGAKDVRNLSSKAVNHIHSVWKDLLEDSETPIDTTIMAKNEIFCVQPEKGGRKSARLIVFPDLGVRVCEKMALYDVVSKLPVAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGTGKRVYYLTRDPTIPLARAAWETARHTPINSWLGNIIMFAPTLWARMILMTHFFSVLIARDQLEQALDCEIYGACYSIEPLDLPLIIQRLHGLSAFSLHSYSPGEINRVAACLRKLGVPPLRAWRHRARNVRARLLSRGGRAAICGKYLFNWAVRTKLKLTPIAAASQLDLSGWFVAGYGGGDIYHSLSRARPRWFWFCLLLLAAGVGIYLLPNR

SEQ ID NO: 9 - skipped

SEQ ID NO: 10 - protein, 3010 aa, Artificial Sequence
  Recombinant polypeptide
MSTNPKPQRKIKRNTNRRPQDVKFPGGGKIVGGVYLLPRRGPRLGVRTTRKTSERSQPRGRRQPIPKARQPEGRTWAQPGYPWPLYGNEGCGWAGWLLSPRGSRPNWGPTDPRRRSRNLGKVIDTLTCGLADLMGYIPLVGGPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAMTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAETHVTGGSAAKDTSGFTSLFRIGARQNIQLINTNGSWHINRTALNCNASLDTGWVAGLFYYHKFNSSGCPERLASCRPLADFDQGWGPISYANGSGPDQRPYCWHYPPKPCGIVPAKSVCGPVYCFTPSPVVVGTTDRSGAPTYNWGENETDVLVLNNTRPPLGNWFGCTWMNSSGFTKVCGAPPCVIGGVGNNTLHCPTDCFRKHPEATYSRCGSGPWITPRCLVNYPYRLWHYPCTVNYTLFKVRMYVGGVEHRLDAACNWTRGERCDLDDRDRSELSPLLLSTTQWQVLPCSFTSLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKHYISWCLWWLQYFLTRVEAHLHVWVPPLDVRGGRDAVILLMCVVHPTLVFDITKLLLAVFGPLWILQASLLKVPYFVRVQGLLRICALARKMAGGHYVQMAIIKLGALTGTYIYNHLTPLRDWAHNGLRDLAVAVEPVVFSQMETKLITWGADTAACGDIINGLPVSARRGQEILLGPADGMVSKGWRLLAPITAYSQQTRGLLGCIVTSLTGRDKNQAEGEVQIVSTAAQTFLATCINGVCWTVYHGAGTRTIASPKGPVIQMYTNVDKDLVGWPAPQGARSLTPCTCGSSDLYLVTRHADVIPVRRRGDSRGGLLSPRPISYLKGSSGGPLLCPAGHAVGIFRAAVCTRGVAKAVDFIPVENLETTMRSPVFTDNSSPPVVPQSFQVAHLHAPTGSGKSTRVPAAYAAQGYKVLVLNPSVAATLGFGAYMSKAHGIDPNIRTGVRTITTGGPITYSTYCKFLADGGCSGGAYDIIICDECHSTDATSILGIGTALDQAETAGARLVVLATATPPGSVTVSHPNIEEVALSTTGEIPFYGKAIPLEVIKGGRHLIFCHSKKKCDELAAKLVALGINAVAYYRGLDVSVIPTSGNVVVVATDALMTGFTGDFDSVIDCNTCVTQTVDFSLDPTFTIETTTLPQDAVSRTQRRGRTGRGKPGIYRFVAPGERPSGMFDSSILCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGSTPLLYRLGAVQNEVTLTHPVTKYIMTCMSADLEVVTSTWVLVGGVLAALAAYCLSTGCVVIVGRIVLSGKPAIIPDREVLYQEFDEMEECSQQLPYIEQGMMLAEQFKQKAFGLLQTASRQAEVIAPAVQTNWQKLEAFWAKHMWNFVSGIQYLAGLSTLPGNPAIASLMAFTAAVTSPLTTSQTLLFNILGGWLAAQLAAPGAATTFVGAGLAGAAIGSVGLGKVLVDILAGYGAGVAGALVAFKIMSGEAPSTEDLINLLPAILSPGALVVGVVCAAVLRRHVGPGEGAVQWMNRLIAFASRGNHVSPTHYVPESDAAARVTTILSSLTVTQLLRRLHQWISSECTTPCSGSWLKDVWDWICTVLSDFKTWLQSKLLPRLPGLPFLSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVTVVTSMLTDPSHITAETAKRRLARGSPPSLASSSASQLSAPSLKATCTTRHDSPDADLVEANLLWRQEMGGNITRVESENKVVILDSFEPLRAEEDEREVSVPAEILRKTRKFPPALPIWARPDYNPPLLESWKDPDYVPPVVHGCPLPPTKAPPIPPPRRKRTVVLSESTVSSALAELATKTFGSSESSAVDSGTATAPPDQASDDGDKGSDVESYSSMPPLEGEPGDPDLSDGSWSTVSEEAGEDVVCCSMSYTWTGALITPCAAEESKLPINPLSNSLLRHHSMVYSTTSRSASLRQKKVTFDRLQVLDDHYRDVLKEMKAKASTVKAKLLSIEEACKLTPPHSAKSKYGYGAKDVRNLSSRAVNHIRSVWEDLLEDTETPIDTTIMAKSEVFCVQPEKGGRKPARLIVFPDLGVRVCEKMALYDVVSTLPQAVMGSSYGFQYSPKQRVEFLVNTWKSKKCPMGFSYDTRCFDSTVTESDIRVEESIYQCCDLAPEARQAIKSLTERLYIGGPLTNSKGQNCGYRRCRASGVLTTSCGNTLTCYLKATAACRAAKLRDCTMLVNGDDLVVICESAGTQEDAANLRVFTEAMTRYSAPPGDPPRPEYDLELITSCSSNVSVAHDASGKRVYYLTRDPTTPIARAAWETARSTPVNSWLGNIIMYAPTLWARMVLMTHFFSILIAQEQLEKALDCQIYGACYSIEPLDLPQIIERLHGLSAFSLHSYSPGEINRVAACLRKLGVPPLRAWRHRARSVRAKLLSRGGRAAICGRYLFNWAVKTKLKLTPIAAAGQLDLSGWFTAGYSGGDIYHSVSHARPRWFWFCLLLLTAGVGIYLLPNR

SEQ ID NO: 11 - protein, 3010 aa, Artificial Sequence
  Recombinant polypeptide
MSTNPKPQRRTKRNTNRRPQDVKFPGGGQIVGGVYLLPRRGPKLGVRATRKTSERSQPRGRRQPIPKARRPEGRAWAQPGYPWPLYGNEGLGWAGWLLSPRGSRPSWGPTDPRRRSRNLGRVIDTLTCGFADLMGYIPFVGAPLGGAARALAHGVRVLEDSVNYATGNLPGCSFSIFLLALLSCLTTPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVMDMVAGAHWGILAGLAYYSMAGNWAKVLLVLLLFAGVDGNTRVSGGEAAKNTMGFASLFVSGPSQKIQLINTNGSWHINSTALNCNDSLQTGFLAALFYTHKFNSSGCPERMASCRSIDKFDQGWGPITYAEPGSSDQRPYCWHYAPKPCGIVPASQVCGPVYCFTPSPVVVGTTDRFGAPTYTWGENETDVLILNNTRPPQGNWFGCTWMNGTGFTKTCGAPPCNIGGVGNNTLTCPTDCFRKHPDATYTKCGSGPWLTPRCMVDYPYRLWHYPCTVNFTIFKVRMYVGGVEHRLSAACNWTRGERCNLEDRDRSELSPLLLTTTQWQVLPCSFTTLPALTTGLIHLHQNVVDVQYLYGVGSSIVSWAIKWEYVILLFLLLADARICSCLWMMLLISQVEAALENLVLLNAASLAGTHGLASFLVFFCFAWYLKGKWVPGAVYAFYGMWPLLLLLLALPQRAYALDTEMAASCGGAVFVGLALLTLSPYYKRYISWCLWWLQYFLTRVEAQLHVWVPPLNVRGGRDAIILLTCAVHPELIFEITKILLAIIGPLMVLQAGLTRVPYFVRAQGLIRVCMLVRKAAGGHYVQMAIIKLGALTGTYVYNHLTPLRDWAHTGLRDLAVAVEPVVFSDMETKVITWGADTAACGDIILGLPVSARRGREILLGPADSLEGRGWRLLAPITAYAQQTRGLFGCIITSLTGRDRNQVEGEVQVVSTATQSFLATCINGVCWTVYHGAGSKTLAGPKGPVTQMYTNVDQDLVGWQAPPGARSLTPCTCGSSDLYLVTRHADVIPVRRRGDGRGSLLSPRPVSYLKGSSGGPLLCPSGHAVGIFRAAVCTRGVAKAVDFIPVESLETTMRSPVFTDNSSPPAVPQSFQVAYLHAPTGSGKSTKVPAAYAAQGYTVLVLNPSVAATLGFGAYMSKAHGVDPNIRTGVRTITTGASITYSTYGKFLADGGCSGGAYDVIICDECHSTDATTILGVGTVLDQAETAGARLVVLATATPPGSVTVPHSNIEEVALSNTGEVPFYGKAIPIETIKGGRHLIFCHSKKKCDELAAKLSGLGLNAVAYYRGLDVSVIPASGDVVVVATDALMTGYTGDFDSVIDCNTCVTQSVDFSLDPTFTIETITLPQDAVSRSQRRGRTGRGRRGIYRFVTPGERPSGMFDSVVLCECYDAGCAWYELTPAETSVRLRAYLNTPGLPVCQDHLEFWESVFTGLTHIDAHFLSQTKQAGDNFPYLVAYQATVCARAKAPPPSWDQMWKCLVRLKPTLHGPTPLLYRLGAVQNEVILTHPITKYIMACMSADLEVVTSTWVLVGGVLAALAAYCLTTGCVVIVGRVVLSGKPAIIPDREILYREFDEMEECSQHLPYIEQGMALAEQFKQKALGLLQTASRQAEVITPAVQTNWQKLEVFWAKHMWNFISGVQYLAGLSTLPGNPAIASLMAFTASVTSPLTTQNTLLFNILGGWVAAQLAPPSAASAFVGAGIAGAAIGSIGLGKVLVDVLAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWISEDCSTPCSGSWLRDIWDWICTVLTDFKTWLQSKLLPRLPGVPFLSCQRGYRGVWRGDGIMHTTCPCGAQITGHVKNGSMRIVGPKTCSNTWHGTFPINAHTTGPCTPSPAPNYSKALWRVAAEEYVEVRRVGDFHYVTGMTTDNIKCPCQVPAPEFFTELDGVRLHRYAPACKPLLRDEVTFQVGLNQYVVGSQLPCEPEPDVTVLTSMLTDPPHITAEAARRRLARGSPPSMASSSASQLSAPSLKATCTTHHDSPDADLIEANLLWRQEMGGNITRVESENKVVILDSFDPLRAEEDEREVSVAAEILRKSRRFAPALPIWARPDYNPPLLETWKKPDYEPPVVHGCPLPPPQSPPVPPPRKKRMVVLTESTVSSALAELATKTFGSSGSSAVDSGTATAPPDQPSDDGDAGSDVESYSSMPPLEGEPGDPDLSDGSWSTVSEEASEDVVCCSMSYTWTGAMITPCAAEESKLPINALSNPLLRHHNMVYATTSRSASQRQKKVTFDRLQVLDDHYQDVLKEMKAKASTVKAKLLSVEEACKLTPPHSARSKFGYGAKDVRSLSSKAVNHIRSVWKDLLEDTETPIDTTVMAKNEVFCIQPEKGGRKPARFIVFPDLGVRVCEKMALYDVVSTLPQAVMGPSYGFQYSPGQRVEFLVNAWKSKKCPMGFAYDTRCFDSTVTENDIRVEESIYQSCDLAPEARQAIRSLTERLYVGGPLTNSKGQSCGYRRCRASGVLTTSCGNTLTCYLKASAACRAAKLQDCTMLVNGDDLVVICESAGTQEDAASLRVFTEAMTRYSAPPGDPPKPEYDLELITSCSSNVSVAHDATGKRVYYLTRDPTTPLARAAWETARHTPVNSWLGNIIMYAPTLWVRMILMTHFFSILLAQEQLEKALDCQIYGATYSIEPLDLPQIIQRLHGLSAFSLHSYSPGEINRVATCLRKLGVPPLRVWRHRARSVRAKLLSQGGRAATCGRYLFNWAVRTKLKLTPIPAASQLDLSSWFVAGYSGGDIYHSLSRARPRWFMWCLLLLSVGVGIYLLPNR

SEQ ID NO: 12 - protein, 3011 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAAKDTSGFTSLFRIGARQNIQLINTNGSWHINRTALNCNASLDTGWVAGLFYYHKFNSSGCPERMASCRSLADFDQGWGPISYANGSGPEHRPYCWHYPPKPCGIVPAKSVCGPVYCFTPSPVVVGTTDRSGAPTYNWGENDTDVFVLNNTRPPLGNWFGCTWMNSTGFTKVCGAPPCVIGGVGNNTLHCPTDCFRKHPEATYSRCGSGPWITPRCLVNYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSGADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 13 - protein, 3011 aa, Artificial Sequence
  Recombinant polypeptide
MSTIPKPQRKTKRNTNRRPQDVKFPGGGQIVGGVYLLPRRGPRLGVRTTRKTSERSQPRGRRQPIPKARRPEGRTWAQPGYPWPLYGNESCGWAGWLLSPRGSRPSWGPSDPRRRSRNLGKVIDTLTCGLADLMGYIPLVGAPLGGAARALAHGVRVLEDGVNYATGNLPGCSFSIFLLALLSCLTVPASAYQVRNSTGLYHVTNDCPNSSIVYETADTILHSPGCVPCVREGNASRCWVAMTPTVATRDGRLPTTQLRRHIDLLVGGATLCSALYVGDLCGSIFLVGQLFTFSPRRHWTTQGCNCSIYPGHITGHRMAWDMMMNWSPTTALVVAQLLRVPQAILDMIAGAHWGVLAGMAYFSMVGNWAKVLVVLLLFAGVDAGTHVTGGSAAKDTSGFTSLFRIGARQNIQLINTNGSWHINSTALNCNDSLNTGWIAGLFYHHKFNSSGCPERLASCRPLTDFDQGWGPISHANGSGPDQRPYCWHYPPRPCGIVPAKSVCGPVYCFTPSPVVVGTTDRSGAPTYNWGENDTDVFVLNNTRPPLGNWFGCTWMNSTGFTKVCGAPPCAIGGVGNNTLRCPTDCFRKHPEATYSRCGSGPWITPRCLVNYPYRLWHYPCTINYTIFKVRMYVGGVEHRLEAACNWTRGERCDLEDRDRSELSPLLLSTTQWQILPCSFTTLPALSTGLIHLHQNIVDVQYLYGVGSSIASWAIKWEYVVLLFLLLADARVCSCLWMMLLISQVEAALENLVILNAASLAGTHGLVSFLVFFCFAWYLKGRWVPGAVYALYGMWPLLLLLLALPQRAYALDTEVAASCGGVVLAGLMALTLSPHYKRYISWCMWWLQYFLTRAEAQLHVWVPPLNVRGGRDAVILLMCVVHPTLVFDITKLLLAIFGPLWILQASLLKVPYFVRVQGLLRICALARKMVGGHYVQMAIIKLGALTGTYIYNHLTPLRDWAHNGLRDLAVAVEPVVFSRMETKLITWGADTAACGDIINGLPVSARRGQEILLGPADGMVSKGWRLLAPITAYAQQTRGLLGCIITSLTGRDKNQAEGEVQIVSTATQTFLATCINGVCWTVYHGAGTRTIASPKGPVIQMYTNVDQDLVGWPAPQGSRSLTPCTCGSSDLYLVTRHADVIPVRRRGDGRGSLLSPRPISYLKGSSGGPLLCPAGHAVGLFRAAVCTRGVAKAVDFIPVENLETTMRSPVFTDNSSPPVVPQSFQVAHLHAPTGSGKSTKVPAAYAAQGYTVLVLNPSVAATLSFGAYMSKAHGVDPNIRTGVRTITTGSPITYSTYGKFLADGGCSGGAYDIIICDECHSTDATSILGIGTVLDQAETAGARLVVLATATPPGSITVPHPNIEEVALSTTGEIPFYGKAIPLEVIKGGRHLIFCHSKKKCDELAAKLVALGINAVAYYRGLDVSVIPTSGNVVVVATDALMTGFTGDFDSVIDCNTCVTQTVDFSLDPTFTIETITLPQDAVSRTQRRGRTGRGKPGIYRFVTPGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLIRLKPTLHGSTPLLYRLGAVQNEVTLTHPITKYIMTCMSADLEIVTSTWVLVGGVLAALAAYCLSTGCVVIVGRIVLSGKPAVIPDREVLYQEFDEMEECSQHLPYIEQGMVLAEQFKQKALGLLQTASRQAEVITPAVQTNWQRLETFWAKHMWNFISGIQYLAGLSTLPGNPAIASLMAFTAAVTSPLTTGQTLLFNILGGWLAAQLAAPGAATAFVGAGLAGAAIGSVGLGKVLVDILAGYGAGVAGALVAFKIMSGDVPSTEDLVNLLPAILSPGALVVGVVCAAILRRHVGPGEGAVQWMNRLIAFASRGNHVSPTHYVQESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEIAGHVKNGTMRIVGPRTCRNMWSGTFPINAYTTGPCTPLPAPNYKFALWRVSAEEYVEIRRVGDFHYVTGMTADNLKCPCQVPSPEFFTELDGVRLHRFAPPCKPLLRDEVSFRVGLHEYPVGSQLPCEPEPDVSVLTSMLTDPSHITAEAAGRRLARGSPPSMASSSASQLSAPSLKATCTANHDSPDAELIEASLLWRQEMGSNITRVESENKVVILDSFDPLVAEEDEREVSVPAEILRKSRRFAQALPVWARPDYNPPLIETWKKPDYEPPVVHGCPLPPPRSPPVPPPRKKRTVVLTESTLSTALAELAAKSFGSSSTSGITGDDTTTSSEPAPSGCPPDSDAESCSSMPPLEGEPGDPDLSDGSWSTVSSGADTEDVVCCSMSYTWTGALVTPCAAEEQKLPINALSNSLLRHHNMVYSTTSRSACQRQKKVTFDRLQVLDSHYQDVLKEVKAAASKVKANLLSVEEACSLTPPHSAKSKFGYGAKDVRCHARKAVAHINSVWKDLLEDSVTPIDTTIMAKNEVFCVQPEKGGRKPARLIVFPDLGVRVCEKMALYDVVSKLPVAVMGSSYGFQYSPGQRVEFLVQAWKSKKTPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALNCEIYGACYSIEPLDLPLIIQRLHGLSAFSLHSYSPGEINRVAACLRKLGVPPLRAWRHRARSVRAKLLSRGGRAAICGKYLFNWAVRTKLKLTPIAAAGRLDLSGWFTAGYSGGDIYHSVSHARPRWFWFCLLLLAAGVGIYLLPNR

SEQ ID NO: 14 - protein, 3011 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGRVIDTLTCGFADLMGYIPLVGAPLGGVARALAHGVRVLEDSVNYATGNLPGCSFSIFLLALLSCLTVPASAYQVRNSSGLYHVTNDCPNSSIVYEAADAILHTPGCVPCVREGNTSRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAILDMIAGAHWGVLAGIAYFSMVGNWAKVLLVLLLFAGVDAETHVTGGSAAKDTSGFTSLFRIGARQNIQLINSNGSWHINRTALNCNASLDTGWVAGLFYYHKFNSSGCPERMASCRPLTDFAQGWGPISYANGSGPEHRPYCWHYPPKPCGIVPAQNVCGPVYCFTPSPVVVGTTDKSGAPTYNWGSNDTDVLVLNNTRPPSGNWFGCTWMNSSGFTKVCGAPPCVIGGVGNNTLHCPTDCFRKHPDATYSRCGSGPWLTPRCLVDYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEAALENLVVLNAASLAGTHGLASFLVFFCFAWYLKGKWVPGAAYAFYGMWPLLLLLLALPQRAYALDTEMAASCGGVVLVGLMALTLSPYYKRYISWCLWWLQYFLTRVEAQLHVWVPPLNVRGGRDAVILLTCVVHPALVFDITKLLLAVFGPLWILQTSLLKVPYFVRVQGLLRLCALARKMAGGHYVQMVIIKLGALTGTYVYNHLTPLRDWAHNGLQDLAVAVEPVVFSQMETKLITWGADTAACGDIIDGLPVSARRGREILLGPADGMDSKGWRLLAPITAYAQQTRGLLGCIVTSLTGRDKNQVEGEVQIVSTAAQTFLATCINGVCWTVYHGAGTRTIASSKGPVIQMYTNVDKDLVGWPAPQGARSLTPCTCGSSDLYLVTRHADVIPVRRRGDSRGSLLSPRPISYLKGSSGGPLLCPAGHAVGIFRAAVCTRGVAKAVDFIPVESLETTMRSPVFTDNSSPPAVPQSFQVAYLHAPTGSGKSTKVPAAYAAQGYKVLVLNPSVAATLGFGAYMSKAHGIDPNIRTGVRTITTGSSITYSTYGKFLADGGCSGGAYDIIICDECHSTDATSVLGIGTVLDQAETAGVRLTVLATATPPGSVTVPHPNIEEAALSTTGEIPFYGKAIPLEAIKGGRHLIFCHSKRKCDELAAKLVALGVNAVAYYRGLDVSVIPTSGDVVVVATDALMTGYTGDFDSVIDCNTCVTQSVDFSLDPTFTIETTTLPQDAVSRTQRRGRTGRGKPGIYRFVAPGERPSGMFDSSILCECYDAGCAWYELTPAETTVRLRSYMNTPGLPVCQDHLEFWEGVFTGLTHIDAHFLSQTKQSGENLPYLVAYQATVCARAQALPPSWDQMWKCLTRLKPTLHGPTPLLYRLGAVQNEITLTHPVTKYIMTCMSADLEVVTSTWVLVGGVLAALTAYCLSTGCVVIVGRVVLSGKPAIIPDREVLYREFDEMEECSQHLPYIEQGMMLAEQFKQKAFGLLQTASRQAEVIAPAVQTNWQKLEAFWAKHMWNFISGIQYLAGLSTLPGNPAIASLMAFTAAVTSPLTTSQTLLFNILGGWVAAQLAAPGAATSFVGAGLAGAAVGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTTILSSLTVTQLLRRLHQWVSSESTTPCSGSWLRDVWDWICEVLSDFKIWLKAKLMPQLPGIPFVSCQRGYKGVWRGDGVMHTRCHCGAEITGHVKNGTMRIVGPKTCRNMWSGTFPINAYTTGPSTPLPAPNYTFALWRVSAEEYVEIRQVGDFHYVTGMTTDNLKCPCQVPSPEFFTELDGVRLHRYAPPCKPLLREEVSFRVGLHDYPVGSQLPCEPEPDVAVLTSMLTDPSHITAEAARRRLARGSPPSVASSSASQLSAPSLKATCTTNHDSPDAELIEANLLWRQEMGGNITRVESENKVVVLDSFDPLVAEEDEREISVPAEILRKSRRFAPALPIWARPDYNPPLLETWKKPDYEPPVVHGCPLPPPQSPPVPPPRRKRTVVLTESTVSTALAELATKSFGSSSTSGITGDNTTTSSEPASSGCPPDSDAESYSSMPPLEGEPGDPDLSDGSWSTVSSEAGTEDVVCCSMSYSWTGALITPCAAEEQKLPINALSNSLLRHHNLVYSTTSRSACLRQKKVTFDRLQVLDNHYQDVLKEVKAAASTVKANLLSVEEACSLTPPHSARSKFGYGAKDVRCHARKAVNHINSVWKDLLEDNVTPIDTTIMAKNEVFCVQPEKGGRKPARLIVYPDLGVRVCEKMALYDVVSKLPLAVMGSSYGFQYSPAQRVEFLVQAWKSKRTPMGFSYDTRCFDSTVTESDIRTEEAIYQCCDLDPQARVAIKSLTERLYVGGPLTNSKGENCGYRRCRASGVLTTSCGNTLTCYIKAQAACRAAGLRDCTMLVCGDDLVVICESQGVQEDAANLRAFTEAMTRYSAPPGDPPQPEYDLELITSCSSNVSVAHDGTGKRVYYLTRDPTTPLARAAWETARHTPINSWLGNIIMFAPTLWVRMILLTHFFSVLIARDQLEQALDCEIYGACYSIEPLDLPPIIQRLHGLSAFSLHSYSPGEINRVATCLRKLGVPPLRTWRHRARSVRARLLSRGGRAAICGRYLFNWAVKTKLKLTPIAAAGQLDLSGWFTAGYSGGDIYHSVSRARPRWFWFCLLLLTAGVGIYLLPNR

SEQ ID NO: 15 - protein, 3011 aa, Artificial Sequence
  Recombinant polypeptide
MSTNPKPQRKTKRNTNRRPQDVKFPGGGQIVGGVYLLPRRGPRLGVCATRKTSERSQPRGRRQPIPKARRSEGRTWAQPGFPWPLYGNEGCGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGRLPTTQLRRHIDLLVGSATLCSALYVGDLCGSIFLVGQLFTFSPRRHWTTQDCNCSMYPGHITGHRMAWDMMMNWSPTTALVMAQLLRIPQAILDMIAGAHWGVLAGMAYFSMVGNWAKVLVVLLLFAGVDAETHVTGGSAAKDTSGFTSLFRIGARQNIQLINSNGSWHINRTALNCNASLDTGWVAGLFYYHKFNSSGCPERMASCRPLADFDQGWGPISYANGSGPEHRPYCWHYPPKPCGIVPAQSVCGPVYCFTPSPVVVGTTDRSGAPTYSWGENDTDVLVLNNTRPPSGNWFGCTWMNSTGYTKVCGAPPCAIGGVGNNTLRCPTDCFRKHPEATYARCGSGPWITPRCLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEAALENLVLLNAASLAGMHGLASFLVFFCFAWYLKGRWVPGAAYALYGMWPLLLLLLALPQRAYALDTEMAASCGGVVLVGLMALTLSPYYKHYISWCLWWLQYLLTRAEAQLHVWVPPLDARGGRDAVILLTCVVHPTLIFDITKLLLAVLGPLWILQASLLKVPYFVRVQGLLRICALARKMVGGHYVQMAIIKLGALTGTYVYNHLTPLRDWAHNSLQDLAVAVEPVVFSQMETKLITWGADAAACGDIINGLPVSARRGQEILLGPADGMVSKGWRLLAPITAYAQQTRGLLGCIITSLTGRDKNQAEGEVQIVSTATQTFLATCINGVCWSIYHGAGTRTIASPKGPVIQMYTNVDKDLVGWPAPQGTRSLTPCACGSSDLYLVTRHADVIPVHRRGDSRGSLLSPRPISYLKGSSGGPLLCPAGHAVGIFRAAVCTRGVAKAVDFIPVENLETTMRSPVFTDNSSPPAVPQSFQVAYLHAPTGSGKSTKVPAAYAAQGYKVLVLNPSVAATLSFGAYMSKAHGVEPNIRTGVRTITTGSPITYSTYGKFLADGGCSGGAYDIIICDECHSTDATSILGIGTVLDQAETAGARLTVLATATPPGSVTVPHPNIEEVGLSTTGEIPFYGKAIPLEAIKGGRHLIFCHSKKKCDELAAKLVALGVNAVAYYRGLDVSIIPTSGDVVVVATDALMTGFTGDFDSVIDCNTCVTQTVDFSLDPTFTIETTTLPQDAVSRTQRRGRTGRGKPGIYRFVAPGERPSGMFDSSILCECYDAGCAWYELTPAETTVRLRSYMNTPGLPVCQDHLEFWEGVFTGLTHIDAHFLSQTKQGGENFPYLVAYQATVCARAQAPPPSWDQMWKCLVRLKPTLHGPTPLLYRLGAVQNEITLTHPITKYIMTCMSADLEIVTSTWVLVGGVLAALAAYCLSTGCVVIVGRIVLSGKPAVIPDREVLYREFDEMEECSQHLPYIEHGMMLAEQFKQKALGLLQTASRQAEVITPVVQTNWQKLEAFWAKHMWNFISGIQYLAGLSTLPGNPAIASLMAFTAAVTSPLTTSQTLLFNVLGGWVAAQLAAPGAATSFVGAGLAGAAVGSVGLGKVLVDIIAGYGAGVAGALVAFKIMSGEVPSTEDLVNLLPAILSPGALVVGVVCAAILRRHVGPGEGAVQWMNRLIAFASRGNHVSPTHYVPESDAAARVTNILSSLTVTQLLRRLHQWVSSECTTPCSDSWLRDIWDWICEVLSDFKTWLKAKLVPQLPGIPFVSCQRGYKGVWRGDGVMHTRCHCGAEIAGHVKNGTMRIVGPKTCRNMWSGTFPINAYTTGPSTPLPAPNYTFALWRVSAEEYVEVRQVGDFHYVTGMTTDNLKCPCQVPSPEFFTELDGVRIHRFAPPCKPLLRDEVSFRVGLHDYPVGSQLPCEPEPDVTVVTSMLTDPSHITAEAAGRRLARGSPPSVASSSASQLSAPSLKATCTANHDSPDAELIEASLLWRQEMGSNITRVESENKVVVLDSFDPLVAEEDEREVSVPAEILRKSRRFTPALPIWARPDYNPPLLETWKKPDYEPPVVHGCPLPPPRSPPVPPPRRKRTVVLTESSVSTALAELATKSFGSSSTSGITGDDTTTPSEPAPSACPPDSDAESCSSMPPLEGEPGDPDLSDGSWSTVSSGADTEDVVCCSMSYSWTGALITPCAAEEQKLPINALSNSLLRHHNLVYSTTSRSACLRQKKVTFDRLQVLDSYYQDVLKEVKAAASTVKANLLSVEEACSLTPPHSARSKFGYGAKDVRSHARKAVNHINSVWEDLLEDNVTPIDTTIMAKNEVFCVQPEKGGRKPARLIVFPDLGVRVCEKRALYDVVSKLPVAVMGSSYGFQYSPGQRVEFLVQAWKSKKTPMGFSYDTRCFDSTVTESDIRTEEAIYQCCDLDPQARVVIKSLTERLYVGGPLTNSKGENCGYRRCRASGVLTTSCGNTLTCYIKAKAACRAAGLRDCTMLVCGDDLVVICESQGVQEDAASLRAFTEAMTRYSAPPGDPPQPEYDLELITSCSSNVSVAHDGTGKRVYYLTRDPTTPLARAAWETARHTPINSWLGNIIMFAPTLWARMILMTHFFSVLIARDQLEQALDCEIYGACYSIEPLDLPLIIQRLHGLSAFSLHSYSPGEINRVAACLRKLGVPPLRAWRHRARSVRARLLSRGGKAAICGKYLFNWAVRTKLKLTPIAAASQLDLSGWFTAGYSGGDIYHSVSRARPRWIWFCLLLLTAGVGIYLLPNR

SEQ ID NO: 16 - protein, 3011 aa, Artificial Sequence
  Recombinant polypeptide
MSTNPKPQRRTKRNTNRRPQDVKFPGGGQIVGGVYLLPRRGPRLGVRTTRKTSERSQPRGRRQPIPKARRPEGRTWAQPGYPWPLYGNESCGWAGWLLSPRGSRPSWGPSDPRRRSRNLGRVIDTLTCGFADLMGYIPFVGAPLGGAARALAHGVRVLEDGVNYATGNLPGCSFSIFLLALLSCLTVPASAYQVRNSSGIYHVTNDCPNSSIVYETADAILHSPGCVPCVREGNTSRCWVAMTPTVATRDGKLPATQLRRHIDLLVGGATLCSALYVGDLCGSVFLVSQLFTFSPRRHWTTQGCNCSIYPGHITGHRMAWDMMMNWSPTAALVVAQLLRIPQAIMDMIAGAHWGVLAGIAYFSMVGNWAKVLLVLLLFAGVDAGTHVTGGSAAKDTSGFTSLFRIGARQNIQLINSNGSWHINRTALNCNESLNTGWLAGLFYQHKFNSSGCPERLASCRPLTDFAQGWGPISHANGSGPDQRPYCWHYPPRPCGIVPAQNVCGPVYCFTPSPVVVGTTNKLGAPTYNWGENETDVFVLNNTRPPLGNWFGCTWMNSTGFTKVCGAPPCVIGGVGNNTLLCPTDCFRKHPDATYSRCGSGPWITPRCLVNYPYRLWHYPCTINYTIFKVRMYVGGVEHRLDAACNWTRGERCDLEDRDRSELSPLLLTTTQWQVLPCSFTSLPALSTGLIHLHQNIVDVQYLYGVGSSIASWAIKWEYVVLLFLLLADARVCSCLWMMLLISQVEAALENLVILNAASLAGTHGLASFLVFFCFAWHLKGRWVPGAVYALYGMWPLLLLLLALPQRAYALDTEVAASCGGAVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRVCALARKMAGGHYVQMVIIKLGALTGTYIYNHLTPLRDWAHNGLQDLAVAVEPVVFSRMETKLITWGADTAACGDIINGLPVSARKGREILLGPADGMASKGWRLLAPITAYAQQTRGLLGCIITSLTGRDKNQVEGEIQIVSTAAQTFLATCINGVCWTVYHGAGTRTIASSKGPVIQMYTNVDQDLVGWPAPQGSRSLTPCTCGSSDLYLVTRHADVIPVRRRGDSRGSLLSPRPISYLKGSSGGPLLCPAGHAAGIFRAAVCTRGVAKAVDFIPVEGLETTMRSPVFTDNSSPPVVPQSFQVAHLHAPTGSGKSTKVPAAYAAQGYKVLVLNPSVAATLGFGVYMSKAHGVDPNIRTGVRTITTGSPITYSTYGKFLADGGCSGGAYDIIICDECHSTDATSVLGIGTVLDQAETAGVRLTVLATATPPGSVTVSHPNIEEVALSTTGEIPFYGKAIPLEVIKGGRHLIFCHSKKKCDELAAKLVALGINAVAYYRGLDVSVIPTSGDVVVVSTDALMTGFTGDFDSVIDCNTCVTQSVDFSLDPTFTIETITLPQDAVSRTQRRGRTGRGRPGIYRFVAPGERPSGIFDSSVLCECYDAGCAWYELTPAETTVRLRAYMNTPGLPVCQDHLEFWEGVFTGLTHIDAHFLSQTKQSGENLPYLVAYQATVCARARAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIVPDREVLYREFDEMEECSQHLPYIEQGMALAEQFKQKALGLLQTASRQAEVITPAVQTNWQKLEVFWAKHMWNFISGIQYLAGLSTLPGNPAIASLMAFTAAVTSPLTTGQTLLFNILGGWLAAQLAAPGAATAFVGAGLAGAAIGSVGLGKVLVDILAGYGAGVAGALVAFKIMSGDVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDVWDWICEVLSDFKTWLKAKLMPQLPGIPFVSCQRGYRGVWQGDGIMHTRCHCGAEITGHVKNGTMRIAGPRTCRNMWSGTFPINAYTTGPCTPLPAPNYSFALWRVSAEEYVEIRRVGDFHYVSGMTTDNLKCPCQIPSPEFFTELDGVRLHRYAPPCKPLLRDEVSFRVGLHAYPVGSQLPCEPELDVAVLTSMLTDPSHITAEAARRRLARGSPPSMASSSASQLSAPSLKGTCTANHDSPDAELIEANLLWRQEMGGNITRVESENKVVILDSFEPLVAEEDEREISVPAEILRKSRRFAPALPIWARPDYNPPLVETWKKPDYEPPVVHGCPLPPPQSPPVPPPRKKRTVVLTESTLSTALAELATRSFGSSSTSGITGDNTTTSSEPAPSGCPPDSDVESYSSMPPLEGEPGDPDLSDGSWSTVSSGADAEDVVCCSMSYSWTGALVTPCAAEEQKLPINALSNSLLRHHNMVYSTTSRSASQRQKKVTFDRLQVLDSHYQDVLKEVKAAASKVKASLLSVEEACSLTPPHSAKSKFGYGAKDVRCHARKAVAHINSVWKDLLEDSETPIDTTIMAKNEVFCVQPEKGGRKPARLIVYPDLGVRVCEKMALYDVVSKLPLAVMGSSYGFQYSPAQRVEFLVQAWKSKKNPMGFSYDTRCFDSTVTENDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETAKHTPVNSWLGNIIMFAPTLWARMILMTHFFGVLIARDQLEQALNCEIYGACYSIEPLDIPPIIQRLHGLSAFSLHSYSPGEINRVAACLRKLGVPPLRAWRHRARNVRARLLSRGGRAAICGKYLFNWAVKTKLKLTPIAAAGRLDLSGWFTAGYSGGDIYHSVSHARPRWFWFSLLLLAAGVGIYLLPNR

SEQ ID NO: 17 - protein, 3011 aa, Artificial Sequence
  Recombinant polypeptide
MSTNPKPQRQTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGLADLMGYIPLVGAPLGGAARALAHGVRVLEDSVNYATGNLPGCSFSIFLLALLSCLTVPTSAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRHHWTTQDCNCSIYPGHITGHRMAWDMMMNWSPTTALVVAQLLRVPQAILDMIAGAHWGVLAGLAYFSMVGNWAKVIVVLLLFAGVDAGTHVTGGSAAKDTSGFTSLFRIGARQNIQLINTNGSWHINSTALNCNDSLNTGWIAGLFYHHKFNSSGCSERLASCRPLTDFDQGWGPISYTNGSGPDHRPYCWHYPPKPCGIVPAKSVCGPVYCFTPSPVVVGTTDKSGAPTYNWGENDTDVFVLNNTRPPLGNWFGCTWMNSSGFTKVCGAPPCVIGGVGNNTLHCPTDCFRKHPEATYSRCGSGPWLTPRCLVDYPYRLWHYPCTINYTIFKIRMYVGGVEHRLEAACNWTRGERCNLDDRDRSELSPLLLSTTQWQILPCSFTTLPALSTGLIHLHQNVVDVQYLYGVGSSIASWAIKWDYVVLLFLLLADARVCSCLWMMLLISQAEAALENLVVLNAASLAGTHGLVSFLVFFCFAWYLKGKWVPGAVYAFYGMWPLLLLLLALPQRAYAQDTEVAASCGGVVLAGLMALTLSPHYKRYISWCLWWLQYFLTRAEALLHVWVPPLNVRGGRDAIILLMCVVHPALVFDITKLLLAVFGPLWILQTSLLKVPYFVRVQGLLRLCALVRKMAGGHYVQMAIIKVGALTGTYVYNHLTPLRDWAHNGLRDLAVAVEPVVFSPMETKLITWGADTAACGDIIDGLPVSARRGREILLGPADGVVSKGWRLLAPITAYAQQTRGLLGCIVTSLTGRDKNQVEGEVQIVSTAAQTFLATCVNGVCWTVYHGAGTRTLASSKGPVIQMYTNVDQDLVGWPAPQGARSLTPCTCGSSDLYLVTRHADVIPVRRRGDGRGSLLSPRPISYLKGSSGGPLLCPAGHAVGLFRAAVCTRGVAKAVDFIPVESLETTMRSPVFSDNSSPPAVPQCYQVAHLHAPTGSGKSTKVPAAYAAQGYTVLVLNPSVAATLGFGAYMSKAHGIDPNIRTGVRTITTGSSITYSTYGKFLADGGCSGGAYDIIICDECHSTDATSILGIGTALDQAETAGARLVVLATATPPGSITVPHPNIEEVALSTTGEIPFYGKAIPLETIKGGRHLIFCHSKKKCDELAAKLTALGINAVAFYRGLDVSVIPASGDVVVVATDALMTGYTGDFDSVIDCNTCVTQTVDFSLDPTFTIETTTLPQDAVSRTQRRGRTGRGKPGIYRFVTPGERPSGMFDSSVLCECYDTGCAWYELTPAETTVRLRAYMNTPGLPVCQDHLEFWEGVFTGLTHIDAHFLSQTKQSGENFPYLVAYQATVCARAQALPPSWDQMWKCLTRLKPTLHGPTPLLYRLGAVQNEVTLTHPITKYIMTCMSADLEVVTSTWVLVGGVLAALTAYCLSTGCVVIVGRVVLSGKPAIIPDREVLYQEFDEMEECSQHLPYIEQGMMLAEQFKQKAFGLLQTASRQAEVIAPAVQTNWQRLETFWAKHMWNFISGIQYLAGLSTLPGNPAIASLMAFTAAVTSPLTTSQTLLFNILGGWVAAQLAAPGAATAFVGAGLTGAAIGSVGLGKVLIDILAGYGAGVAGALVAFKIMSGEVPSTEDMVNLLPAILSPGALVVGVVCAAILRRHVGPGEGAVQWMNRLIAFASRGNHVSPTHYVPESDAAARVTTILSSLTVTQLLRRLHQWISSESTTPCSGSWLRDIWDWICEVLSDFKIWLKAKLMPQLPGIPLVSCQRGYRGVWRGDGIMHTRCHCGAEITGHVRNGTMRIVGPRTCRNMWNGTFPINAYTTGPCTPLPAPNYKFALWRVSAEEYVEIRQVGDFHYVTGMTADNLKCPCQVPSPEFFTELDGVRLHRFAPPCKPLLREEVSFRVGLHEYPVGSQLPCEPEPDVAVLTSMLTDPSHITAETAKRRLARGSPPSEASSSASQLSAPSLKATCTTNHDSPDAELLEANLLWRQEMGGDITRVESKNKVVILDSFDPLVAEEDEREISVPAEILRKSRRFAQALPVWARPDYNPPLIETWKKPDYEPPVVHGCPLPPPKSPPVPPPRRKRTVVLTESTVSTALAELATKSFGSSSTSGVTGDNTTTSSEPASSGCPPDSDAESYSSMPPLEGEPGDPDLSDGSWSTVSSEAGTEDVVCCSMSYTWTGALITPCAAEEQKLPINALSNSLLRYHNLVYSTTSRSACQRQKKVTFDRLQVLDNHYQDVLKEVKAAASKVKANLLSVEEACDLTPPHSAKSKFGYGAKDVRCHARKAVNHINSVWKDLLEDSVTPIDTTIMAKNEVFCVQPEKGGRKAARLIVFPDLGVRVCEKMALYDVVSKLPQAVMGSSYGFQYSPGQRVEFLVQAWKSKRTPMGFSYDTRCFDSTVTESDIRMEEAIYQCCDLDPQARVAIRSLTERLYVGGPLTNSRGENCGYRRCRASGVLTTSCGNTLTCYIKAQAACRAAGLQNCTMLVCGDDLVVICESEGVQEDAANLRAFTEAMTRYSAPPGDPPQPEYDLELITSCSSNVSVAHDDAGKRVYYLTRDPTTPFARAAWETARHTPVNSWLGNIIMFAPTLWVRMIMMTHFFSVLMARDQLEQALDCEIYGACYSIEPLDLPPIIQRLHGLSAFSLHSYSPGEINRVATCLRKLGVPPLRAWRHRARSVRAKLLSRGGRAAICGRYLFNWAVRTKLNLTPIAAAGQLDLSGWFTAGYSGGDIYHSVSRARPRWFWFCLLLLAAGVGIYLFPNR

SEQ ID NO: 18 - protein, 3011 aa, Artificial Sequence
  Recombinant polypeptide
MSTNPKPQRRTKRNTNRRPQDVKFPGGGQIVGGVYLLPRRGPRLGVRTTRKTSERSQPRGRRQPIPKARRPEGRSWAQPGYPWPLYGNEGCGWAGWLLSPRGSRPSWGPTDPRRRSRNLGKVIDTLTCGLADLMGYIPFVGAPLGGAARALAHGVRVLEDGVNYATGNLPGCSFSIFLLALLSCLTVPASAYQVRNSSGIYHVTNDCPNSSIVYETADAILHSPGCVPCVREGNASRCWVAVTPTVATRDGKLPTTQLRRYIDLLVGSATLCSALYVGDLCGSVFLVSQLFTFSPRRHWTTQDCNCSIYPGHVTGHRMAWDMMMNWSPTTALIVAQLLRVPQAILDMIAGAHWGVLAGIAYYSMVGNWAKVVVVLLLFAGVDAGTHVTGGSAAKDTSGFTSLFRIGARQNIQLINSNGSWHINSTALNCNDSLNTGWIAGLFYHHKFNSSGCPERLASCRPLTDFAQGWGPISYANGSGPDQRPYCWHYPPKPCGIVPAKSVCGPVYCFTPSPVAVGTTDRSGAPTYNWGENDTDVFVLNNTRPPLGNWFGCTWMNATGFTKVCGAPPCAIGGVGNNTLRCPTDCFRKHPEATYARCGSGPWLTPRCLVDYPYRLWHYPCTINYTIFKVRMYVGGVEHRLEVACNWTRGERCNLDDRDRSELSPLLLSTTQWQVLPCSFTPMPALSTGLIHLHQNIVDVQYLYGVGSSIASWAIKWDYVVLLFLLLADARVCSCLWMMLLISQAEAALENLVILNAASLAGTHGLVSFLVFFCFAWYLKGRWVPGAVYAVYGMWPLLLLLLALPQRAYALDTEVAASCGGVVLVGLMALTLSPYYKRYISWCMWWLQYFLTRVEAQLHVWVPPLNVRGGRDAVILLTCVVHPTLVFDITKLLLAIFGPLWILQASLLKVPYFVRVQGLLRICALARKIAGGHYVQMAIIKVGALTGTYVYDHLTPLRDWAHNGLRDLAVAVEPVVFSKMETKLITWGADTAACGDIIDGLPVSARRGREVLLGPADGMVSRGWRLLAPITAYAQQTRGLLGCIITSLTGRDKNQVEGEVQIVSTATQTFLATCINGACWTVYHGAGTRTIASPKGPVIQMYTNVDKDLVGWPAPQGTRSLTPCTCGSSDLYLVTRHADVIPVCRRGDSRGSLLSPRPISYLKGSSGGPLLCPAGHAAGIFRAAVCTRGVAKAVDFIPVESLETTMRSPVFTDNSSPPVVPQSFQVAHLHAPTGSGKSTKVPAAYAAQGYKVLVLNPSVAATLSFGAYMSKAHGVEPNIRTGVRTITTGSPITYSTYGKFLADGGCSGGAYDIIICDECHSTDATSVLGIGTALDQAETAGARLVVLATATPPGSVTVPHPNIEEVGLSTTGEIPFYGKAIPLETIKGGRHLIFCHSKKKCDELAAKLVGLGLNAVAYYRGLDVSVIPASGDVVVVATDALMTGYTGDFDSVIDCNTCVTQTVDFSLDPTFTIETTTLPQDAVSRTQRRGRTGRGKPGTYRFVAPGERPSGMFDSSVLCECYDTGCAWYELTPAETTVRLRAYMNTPGLPVCQDHLEFWEGVFTGLTHIDAHFLSQTKQSGESLPYLVAYQATVCARAQAPPPSWDQMWKCLVRLKPTLHGPTPLLYRLGAVQNEVTLTHPITKYIMTCMSADLEVVTSTWVLVGGVLAALAAYCLSTGCVVIVGRIVLSGKPAIIPDREVLYQEFDEMEECSQHLPYIEQGMMLAEQFKQKALGLLQTASRQAEVITPVVQTNWQKLEVFWAKHMWNFISGIQYLAGLSTLPGNPAIASLMAFTAAVTSPLTTGQTLLFNILGGWVAAQLAAPGAATTFVGAGLAGAAIGSVGLGKVLVDIIAGYGAGVAGALVAFKIMSGEVPSTEDLVNLLPAILSPGALVVGVVCAAILRRHVGPGEGAVQWMNRLIAFASRGNHVSPTHYVQESDAAARVTAILSSLTVTQLLRRLHQWVSSECTTPCSDSWLRDIWDWICEVLSDFKTWLKAKLMPQLPGIPFVSCQRGYRGVWQGDGIMHTRCPCGAEIAGHVKNGTMRIVGPKTCRNMWSGTFPINAYTTGPCTPLPAPNYKFALWRVSAEEYVEIRRVGDFHYVTGMTTDDLKCPCQVPSPEFFTELDGVRLHRFAPPCKPLLREEVTFRVGLHDYPVGSQLPCEPEPDVAVLTSMLTDPSHITAEAARRRLARGSPPSEASSSASQLSAPSLKATCTTNHDSPDAELIEASLLWRQEMGGNITRVESENKVVILDSFDPLTAEEDEREISVAAEILRKSRRFTPALPIWARPDYNPPLLETWKKPDYEPPVVHGCPLPPPKSPPVPPPRKKRTVVLTESNLSTALAELATRSFGSSSTSGITGDNTTTSSEPAPSGCPPDSDVESYSSMPPLEGEPGDPDLSDGSWSTVSSGADTEDVVCCSMSYTWTGALVTPCAAEEQKLPINALSNSLLRHHNLVYSTTSRSACQRQKKVTFDRLQVLDSYYQDVLKEVKAAASKVKANLLSVEEACDLTPPHSAKSKFGYGAKDVRSHARKAVNHINSVWEDLLEDNVTPIDTTIMAKNEVFCVQPEKGGRKPARLIVFPDLGVRVCEKMALYDVVSKLPVAVMGSSYGFQYSPGQRVEFLVQAWKSKKNPMGFSYDTRCFDSTVTESDIRMEEAIYQCCDLDPQARVAIKSLTERLYVGGPLTNSRGENCGYRRCRASGVLTTSCGNTLTCYIKARAACRAAGLQNCTMLVCGDDLVVICESAGVQEDAASLRAFTEAMTRYSAPPGDPPQPEYDLELITSCSSNVSVAHDDAGKRVYYLTRDPTTPFARAAWETARHTPVNSWLGNIIMFAPTLWARMILMTHFFSVLIARDQLEQALNCEIYGACYSIEPLDLPPIIQRLHGLSAFSLHSYSPGEINRVAACLRKLGVPPLRAWRHRARSVRARLLSRGGRAATCGKYLFNWAVKTKLKLTPIAAASRLDLSGWFTAGYSGGDIYHSVSRARPRWIWFCLLLLTAGVGIYLLPNR

SEQ ID NO: 19 - protein, 3011 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARRPEGRTWAQPGHPWPLYGNESCGWAGWLLSPRGSRPSWGPSDPRRRSRNLGKVIDTLTCGFADLMGYIPLVGAPLGGVARALAHGVRVLEDGVNYATGNLPGCSFSIFLLALLSCLAVPASAYQVRNSSGLYHVTNDCSNSSIVYETADTILHSPGCVPCVREGNASKCWVAVAPTVATRDGRLPTTQLRRHIDLLVGGATLCSALYVGDLCGSIFLVGQLFTFSPRHHWTTQGCNCSIYPGHITGHRMAWDMMMNWSPTTALVVAQLLRVPQAILDMIAGAHWGVLAGIAYFSMVGNWAKVLLVLLLFAGVDAGTHVTGGSAAKDTSGFTSLFRIGARQNIQLVNTNGSWHINRTALNCNASLDTGWVAGLFYYHKFNSSGCPERMASCRPLADFDQGWGPISHANGSGPDQRPYCWHYAPKPCGIVPAQSVCGPVYCFTPSPVVVGTTDKSGAPTYNWGANDTDVLVLNNTRPPLGNWFGCTWMNSSGYTKVCGAPPCVIGGVGNNTLLCPTDCFRKHPEATYSRCGSGPWITPRCLVNYPYRLWHYPCTINYTVFKVRMYVGGVEHRLDAACNWTRGERCNLEDRDRSELSPLLLSTTQWQVLPCSFATLPALSTGLIHLHQNVVDVQYLYGVGSSVASWAIKWEYVVLLFLLLADARICSCLWMMLLISQVEAALENLVVLNAASLAGAHGLVSFLVFFCFAWYLKGKWVPGAVYALYGMWPLLLLLLALPQRAYAMDTEVAASCGGVVLAGLMVLTLSPYYKHYISWCLWWLQYFLTRAEAQLHVWVPPLNVRGGRDAIILLMCVVHPTLVFDITKLLLAVLGPLWILQASLLKVPYFVRVQGLLRICALARKMVGGHYVQMAIIKLGALTGTYIYNHLTPLQDWAHNGLRDLAAAVEPVVFSRMETKLITWGADTAACGDIINGLPVSARKGREILLGPADGVVSKGWRLLAPITAYAQQTRGLLGCIITSLTGRDKNQAEGEVQIVSTAAQTFLATCVNGVCWTVYHGAGTRTIASSKGPVIQMYTNVDQDLVGWPAPQGSRSLTPCTCGSSDLYLVTRHADVIPVRRRGDSRGGLLSPRPISYLKGSSGGPLLCPEGHAVGIFRAAVCTRGVAKAVDFIPVENLETTMRSPVFTDNSTPPAVPQSYQVAHLHAPTGSGKSTKVPAAYAAQGYKVLVLNPSVAATLGFGAYMSKAHGIDPNIRTGVRTITTGSSITYSTYGKFLADGGCSGGAYDIIICDECHSTDATSILGIGTALDQAETAGVRLTVLATATPPGSVTVPHHNIEEVALSTTGEIPFYGKAIPLEVIKGGRHLIFCHSKKKCDELAAKLVALGVNAVAYYRGLDVSVIPTSGDVVVVATDALMTGFTGDFDSVIDCNTCVTQSVDFSLDPTFTIETITLPQDAVSRTQRRGRTGRGKPGIYRFVAPGERPSGIFDSSVLCECYDAGCAWYELTPAETTVRLRAYMNTPGLPVCQDHLEFWEGVFTGLTHIDAHFLSQTKQGGENFPYLVAYQATVCARAQALPPSWDQMWKCLIRLKPTLHGSTPLLYRLGAVQNEVTLTHPVTKYIMTCMSADLEVVTSTWVLVGGVLAALAAYCLSTGCVVIVGRIVLSGRPAIIPDREVLYREFDEMEECSQHLPYIEQGMVLAEQFKQKALGLLQTASRQAEAITPAVQTNWQKLETFWAKHMWNFISGIQYLAGLSTLPGNPAIASLMAFTAAVTSPLTTSQTLFFNILGGWVAAQLAAPGAATAFVGAGLAGAAIGGVGLGKVLVDILAGYGAGVAGALVAFKIMSGDVPSTEDLVNLLPAILSPGALVVGVVCAAILRRHVGPGEGAVQWMNRLIAFASRGNHVSPTHYVPESDAATRVTAILSSLTVTQLLRRLHQWISSESTTPCSGSWLRDIWDWVCEVLSDFKIWLKAKLMPQLPGVPFVSCQRGYKGVWRGDGIMHTRCHCGAEIAGHVKNGTMRIVGPRTCRNMWNGTFPINAYTTGPCTPLPAPNYEFALWRVSAEEYVEVRRVGEFHYVTGMTADNLKCPCQVPSPEFFTELDGVRLHRFAPPCKPLLRDEVSFRVGLHEYPVGSQLPCEPEPDVSVLTSMLTDPSHITAETAGRRLARGSPPSLASSSASQLSAPSLKATCTANHDSPDAELLEANLLWRQEMGSNITRVESENKVVILDSFEPLVAEEDEREISVPAEILRKSRRFAPALPIWARPDYNPPLLEVWKKPDYEPPVVHGCPLPPSQSPPVPPPRKKRTVVLTESTVSTALAELATKSFGSSSTSGVTGDSTTTPSEPAPSACPPDSDAESCSSMPPLEGEPGDPDLSDGSWSTVSSEADAEDVVCCSMSYTWTGALITPCAAEEQKLPINALSNSLLRHHNMVYSTTSRSACHRQKKVTFDRLQVLDDHYQDVLKEVKTAASKVKANLLSVEEACSLTPPHSAKSKFGYGAKDVRCHARKAVAHINSVWKDLLEDSVTPIDTTIMAKNEVFCVQPEKGGRKPARLIVYPDLGVRVCEKMALYDVVSKLPLAVMGSSYGFQYSPGQRVEFLVQAWKSKRTPMGFSYDTRCFDSTVTESDIRTEEAIYQCCDLDPQARVAIRSLTERLYVGGPLTNSRGENCGYRRCRASGVLTTSCGNTLTCYIKAKAACRAAGLQDCTMLVCGDDLVVICESEGVQEDAANLRAFTEAMTRYSAPPGDPPQPEYDLELITSCSSNVSVAHDGAGKRVYYLTRDPTTPLARAAWETAKHTPVNSWLGNIIMFAPTLWVRMIMMTHFFSVLLARDQLEQALDCEIYGACYSIEPLDLPLIIQRLHGLSAFSLHSYSPGEINRVATCLRKLGVPPLRAWRHRARNVRARLMSRGGRAAICGKYLFNWAVRTKLKLTPIAAASQLDLSGWFTAGYSGGDIYHSVSRARPRWFWFCLLLLAAGVGVYLLPNR

SEQ ID NO: 20 - protein, 3011 aa, Artificial Sequence
  Recombinant polypeptide
MSTIPKPQRKTKRNTNRRPQDVKFPGGGQIVGGVYLLPRRGPRLGVCATRKTSERSQPRGRRQPIPKARRSEGRTWAQPGYPWPLYGNEGCGWAGWLLSPRGSRPSWGPNDPRRRSRNLGKVIDTLTCGFADLMGYIPFVGAPLGGAARALAHGVRVLEDGVNYATGNLPGCSFSIFLLALLSCLTVPTSAYQVRNSTGLYHVTNDCPNSSIVYETADAILHAPGCVPCVREGNTSRCWVAMTPTVATRDGKLPTKQLRRHIDLLVGSATLCSALYVGDLCGSVFLIGQLFTFSPRRHWTTQGCNCSMYPGHITGHRMAWDMMMNWSPTAALVVAQLLRIPQAIMDMIAGAHWGVLAGIAYFSMAGNWAKVLVVLLLFAGVDAGTHVTGGSAAKDTSGFTSLFRIGARQNIQLINTNGSWHINSTALNCNESLNTGWLAGLFYQHKFNSSGCPERLASCRRLTDFDQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLYCPTDCFRKHPDATYSRCGSGPWITPRCLVDYPYRLWHYPCTINYTIFKIRMYVGGVEHRLEAACNWTRGERCDLEDRDRSELSPLLLSTTQWQILPCSFTTLPALSTGLIHLHQNIVDVQYLYGVGSSIASWAIKWEYVVLLFLLLADARVCSCLWMMLLISQVEAALENLVLLNVASLAGTHGLASFLVFFCFAWHLKGRWVPGAAYALYGMWPLLLLLLALPQRAYALDTEMAASCGGVVLVGLMVLTLSPHYKRYISWCFWWLQYFLTRVEAHLHVWVPPLDVRGGRDAVILLMCAVHPALVFDITKLLLAVFGPLWILQTSLLRVPYFVRVQGLLRLCALARKMAGGHYVQMVIIKLGALTGTYVYNHLTPLRDWAHNGLQDLAVAVEPVVFSPMETKLITWGADTAACGDIINGLPVSARRGREILLGPADGMVSKGWRLLAPITAYAQQTRGLLGCIVTSLTGRDKNQAEGEVQIVSTAAQTFLATCINGVCWTVYHGAGTRTLASPKGPVIQMYTNVDKDLVGWPAPQGARSLTPCACGSSDLYLVTRHADVIPVRRRGDSRGSLLSPRPISYLKGSSGGPLLCPAGHAVGIFRAAVCTRGVAKAVDFVPVESLETTMRSPVFTDNSSPPAVPQSFQVAHLHAPTGSGKSTKVPAAYAAQGYTVLVLNPSVAATLGFGVYMSKAHGVDPNIRTGVRTITTGSSITYSTYGKFLADGGCSGGAYDIIICDECHSTDATSILGIGTVLDQAETAGARLTVLATATPPGSVTVSHPNIEEVALSTTGEIPFYGKAIPLDVIKGGRHLIFCHSKKKCDELAAKLTALGINAVAFYRGLDVSVIPTSGNVVVVATDALMTGYTGDFDSVIDCNTCVTQTVDFSLDPTFTIETTTLPQDAVSRTQRRGRTGRGKPGIYRFVTPGERPSGMFDSSILCECYDAGCAWYELTPAETTVRLRSYMNTPGLPVCQDHLEFWEGVFTGLTHIDAHFLSQTKQSGENFPYLVAYQATVCARAQAPPPSWDQMWKCLNRLKPTLHGPTPLLYRLGAVQNEITLTHPITKYIMTCMSADLEIVTSTWVLVGGVLAALAAYCLSTGCVVIVGRVVLSGKPAIIPDREVLYKEFDEMEECSQHLPYIEQGMALAEQFKQKALGLLQTASRQAEVITPAVQTNWQRLEAFWAKHMWNFISGIQYLAGLSTLPGNPAIASLMAFTAAVTSPLTTSQTLLFNILGGWVASQLAAPGAATSFVGAGLAGAAVGSVGLGKVLIDILAGYGAGVAGALVAFKIMSGEVPSTEDMVNLLPAILSPGALVVGVVCAAILRRHVGPGEGAVQWMNRLIAFASRGNHVSPTHYVPESDAAARVTTILSSLTVTQLLRRLHQWISSECTTPCSGSWLREIWDWICEVLSDFKTWLKAKLMPQLPGIPLVSCQRGYRGVWRGDGIMHTRCHCGAEITGHVKNGTMRIVGPRTCRNTWSGTFPINAYTTGPSTPLPAPNYTFALWRVSAEEYVEVRQVGDFHYVTGMTTDNLRCPCQVPSPEFFTELDGVRIHRFAPPCKPLLREEVSFRVGLHAYPVGSQLPCEPEPDVAVVTSMLTDPSHITAEAAGRRLARGSPPSVASSSASQLSAPSLKATCTVNHDSPDADLIEANLLWRQEMGGNITRVESENKVVVLDSFDPLVAEEDEREVSVPAEILRKSRKFTPALPIWARPDYNPPLVETWKKPDYEPPVVHGCPLPPPRSPPVPPPRRKRTVVLTESSVSTALAELATKSFGSSSTSGITGDNTATSSEPAPSGCSPDSDAESYSSMPPLEGEPGDPDLSDGSWSTVSSEAGTEDVVCCSMSYSWTGALVTPCAAEEQKLPINALSNSLLRNHNLVYSTTSRSASQRQKKVTFDRLQVLDSHYQDVLKEVKAAASKVKASLLSVEEACNLTPPHSAKSKFGYGAKDVRCHARKAVNHINSVWKDLLEDNVTPIDTTIMAKNEVFCVQPEKGGRKAARLIVFPDLGVRVCEKMALYDLVSKLPLAVMGSSYGFQYSPGQRVEFLVKAWKSKKTPMGFSYDTRCFDSTVTENDIRTEEAIYQCCDLDPQARVVIKSLTERLYVGGPLTNSRGENCGYRRCRASGVLTTSCGNTLTCYIKAQAACRAAGLRDCTMLVCGDDLVVICESAGVQEDAAGLRAFTEAMTRYSAPPGDPPQPEYDLELITSCSSNVSVAHDGTGKRVYYLTRDPTTPLARAAWETARHTPINSWLGNIIMFAPTLWVRMILLTHFFSVLIARDQLEQALDCEIYGACYSIEPLDLPLIIQRLHGLSAFSLHSYSPGEINRVAACLRKLGVPPLRAWRHRARNVRARLLSRGGKAAICGKYLFNWAVKTKLRLTPIAAAGRLDLSGWFTAGYSGGDIYHSVSHARPRWFWFCLLLLAAGVGIYLLPNR

SEQ ID NO: 21 - protein, 3011 aa, Artificial Sequence
  Recombinant polypeptide
MSTNPKPQRQTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPNWGPTDPRRRSRNLGKVIDTLTCGLADLMGYIPLVGAPLGGAARALAHGVRVLEDSVNYATGNLPGCSFSIFLLALLSCLTVPASAHQVRNSTGLYHVTNDCPNSSIVYEAADAILHTPGCVPCVREGNVSRCWVAITPTVATRDGKLPATQLRRHIDLLVGSATLCSALYVGDLCGSVFLVGQLFTFSPRQHWTTQDCNCSMYPGHITGHRMAWDMMMNWSPTTALVMAQLLRIPQAILDMIAGAHWGVLAGMAYFSMVGNWAKVLVVLLLFAGVDAETHVTGGSAAKDTSGFTSLFRIGARQNIQLINSNGSWHINRTALNCNESLDTGWVAGLLYYHKFNSSGCPERMASCRSLADFDQGWGPISYANGSGPEHRPYCWHYPPKPCGIVPAQNVCGPVYCFTPSPVVVGTTDKAGAPTYNWGENETDVFVLNNTRPPLGNWFGCTWMNSSGFTKVCGAPPCNIGGVGNNTLHCPTDCFRKHPEATYARCGSGPWITPRCLVHYPYRLWHYPCTVNYTLFKVRMYVGGVEHRLDVACNWTRGERCDLDDRDRSELSPLLLTTTQWQVLPCSFTTLPALTTGLIHLHQNIVDVQYLYGVGSSIVSWAIKWEYVILLFLLLADARICSCLWMMLLISQAEAALENLVLLNAASLAGMHGLASFLVFFCFAWYLKGKWVPGAAYAFYGMWPLLLLLLALPQRAYALDSEVAASCGGAVLVGLMALTLSPHYKRYISWCLWWLQYFLTRVEALLHVWVPPLNVRGGRDAVILLMCVVHPALVFDITKLLLAVFGPLWILQTSLLKVPYFVRVQGLLRICALVRKMAGGHYVQMAMIKVGALTGTYIYNHLTPLRDWAHNSLQDLAVAVEPVVFSQMETKLITWGADTAACGDIINNLPVSARRGQEILLGPADGMASKGWRLLAPITAYAQQTRGLLGCIITSLTGRDKNQVEGEIQIVSTAAQTFLATCINGVCWSIYHGAGTRTIASPNGPVIQMYTNVDQDLVGWPAPQGARSLTPCTCGSSDLYLVTRHADVIPVRRRGDGRGSLLSPRPISYLKGSSGGPLLCPAGHAVGLFRAAVCTRGVAKAVDFIPVEGLETTMRSPVFSDNSSPPAVPQCYQVAHLHAPTGSGKSTKVPAAYAAQGYKVLVLNPSVAATLGFGAYMSKAHGVDPNVRTGVRTITTGSPITYSTYGKFLADGGCSGGAYDIIICDECHSTDATSVLGIGTVLDQAETAGARLVVLATATPPGSITVPHPNIEEVALSATGEIPFYGKAIPLEAIKGGRHLIFCHSKKKCDELAAKLVALGINAVAYYRGLDVSVIPTSGDVVVVSTDALMTGFTGDFDSVIDCNTCVTQTVDFSLDPTFTIETTTLPQDAVSRTQRRGRTGRGRPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLTRLKPTLHGPTPLLYRLGAVQNEITLTHPVTKYIMTCMSADLEVVTSTWVLVGGVLAALTAYCLSTGCVVIVGRIVLSGKPAVIPDREVLYREFDEMEECSQHLPYIEHGMMLAEQFKQKALGLLQTASRQAEVIAPAVQTNWQKLEAFWAKHMWNFISGIQYLAGLSTLPGNPAIASLMAFTAAVTSPLTTNQTLLFNILGGWLAAQLAAPGAATAFVGAGLTGAAIGSVGLGKVLVDILAGYGAGVAGALVAFKIMSGETPSTEDLVNLLPAILSPGALVVGVVCAAILRRHVGPGEGAVQWMNRLIAFASRGNHVSPTHYVPESDAAARVTAILGSLTVTQLLRRLHQWISSDCTTPCSGSWLRDVWDWICEVLSDFKTWLKAKLMPQLPGIPFVSCQRGYRGVWRGDGVMHTRCHCGAEITGHVRNGTMRIVGPRTCRNMWSGTFPINAYTTGPCSPLPAPNYKFALWRVSAEEYVEIRQVGDFHYVTGMTTDNLKCPCQIPSPEFFTELDGVRLHRYAPPCKPLLREEVSFRVGLHDYPVGSQLPCEPEPDVTVVTSMLTDPSHITAEAAARRLARGSPPSMASSSASQLSAPSLKATCTTNHDSPDAELIEANLLWRQAMGGNITRVESENKVVILDSFDPLVAEEDEREISVPAEILRKSRRFAQALPVWARPDYNPPLIETWKKPDYEPPVVHGCPLPPPQSPPVPPPRKKRTVVLTESTLSTALAELAAKSFGSSSTSGITGDDTTTSSEPASSGCPPDSDAESYSSMPPLEGEPGDPDLSDGSWSTVSSGADAEDVVCCSMSYSWTGALITPCAAEEQKLPINALSNSLLRHHNLVYSTTSRSACLRQKKVTFDRLQVLDNHYQDVLKEVKAAASTVKANLLSVEEACSLTPPHSARSKFGYGAKDVRCHARKAVTHINSVWKDLLEDSVTPIDTTIMAKNEVFCVQPEKGGRKPARLIVFPDLSVRVCEKMALYDVVSKLPQAVMGSSYGFQYSPGQRVEFLVQAWKSKKTPMGFSYDTRCFDSTVTENDIRTEEAIYQCCDLDPQARVAIKSLTERLYVGGPLTNSKGENCGYRRCRASGVLTTSCGNTLTCYIKAKAACRAAGLRDCTMLVCGDDLVVICESQGVQEDAASLRAFTEAMTRYSAPPGDPPQPEYDLELITSCSSNVSVAHDSAGKRVYYLTRDPTTPLARAAWETARHTPVNSWLGNIIMFAPTLWARMILMTHFFSVLMARDQLEQALDCEIYGACYSIEPLDLPPIIQRLHGLSAFSLHSYSPGEINRVATCLRKLGVPPLRAWRHRARSVRAKLLSRGGRAAICGRYLFNWAVRTKLKLTPIAAAGQLDLSGWFTAGYSGGDIYHSVSRARPRWLWFCLLLLAAGVGIYLLPNR

SEQ ID NO: 22 - protein, 3010 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHVSGHRMAWDMMMNWSPTTALVVSQLLRIPQAVVDMVAGAHWGVLAGLAYYSMVGNWAKVLIVMLLFAGVDGHTHVTGGRVASSTQSLVSWLSQGPSQKIQLVNTNGSWHINRTALNCNDSLQTGFLAALFYTHKFNASGCPERMASCRPIDEFAQGWGPITHDMPESSDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALSTGLIHLHQNIVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLALLTLSPHYKVFLARLIWWLQYFITRAEAHLQVWIPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGREILLGPADSLEGQGWRLLAPITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGVDPNIRTGVRTITTGAPITYSTYGKFLADGGCSGGAYDIIICDECHSTDSTTILGIGTVLDQAETAGARLVVLATATPPGSVTVPHPNIEEVALSNTGEIPFYGKAIPIETIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVTSTWVLVGGVLAALAAYCLTTGSVVIVGRIILSGKPAIIPDREVLYQEFDEMEECASHLPYIEQGMQLAEQFKQKALGLLQTATKQAEAAAPVVESKWRALETFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAETAKRRLARGSPPSLASSSASQLSAPSLKATCTTHHDSPDADLIEANLLWRQEMGGNITRVESENKVVILDSFDPLRAEEDEREVSVPAEILRKSRKFPRAMPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKSKKCPMGFAYDTRCFDSTVTENDIRVEESIYQCCDLAPEARQAIRSLTERLYIGGPLTNSKGQNCGYRRCRASGVLTTSCGNTLTCYLKASAACRAAKLQDCTMLVCGDDLVVICESAGTQEDAASLRVFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRAKLLSQGGRAATCGKYLFNWAVRTKLKLTPIPAASQLDLSGWFVAGYSGGDIYHSLSRARPRWFMWCLLLLSVGVGIYLLPNR

SEQ ID NO: 23 - protein, 3010 aa, Artificial Sequence
  Recombinant polypeptide
MSTNPKPQRKIKRNTNRRPQDVKFPGGGQIVGGVYLLPRRGPRLGVRATRKTSERPQPRGRRQPIPKARQPEGRAWAQPGYPWPLYGNEGLGWAGWLLSPRGSRPSWGPTDPRRRSRNLGKVIDTLTCGLADLMGYIPLVGAPLGGVARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGTAAFCSAMYVGDLCGSVFLVAQLFTFSPRRHETVQDCNCSIYPGHVTGHRMAWDMMMNWSPTAALVVSQLLRIPQAVMDMVAGAHWGILAGLAYYSMVGNWAKVLVVMLLFAGVDGGTHVTGGKVAYTTQGFTSFFSRGPSQKIQLINTNGSWHINRTALNCNDSLNTGFLAALFYTHKFNASGCPERMASCRSIDKFDQGWGPITYAEPHDLDQRPYCWHYAPRPCGIVPASEVCGPVYCFTPSPVVVGTTDRFGVPTYSWGENETDVLLLNNTRPPQGNWFGCTWMNSTGFTKTCGAPPCNIGGVGNNTLTCPTDCFRKHPEATYARCGSGPWLTPRCLVDYPYRLWHYPCTVNFTIFKVRMYVGGVEHRLDAACNWTRGERCNLEDRDRSELSPLLLSTTEWQVLPCSFTTLPALSTGLIHLHQNIVDVQYLYGVGSAVVSFVIKWEYVLLLFLLLADARICACLWMMLLIAQAEAALENLVVLNAASVAGTHGILPFLVFFCAAWYIKGRLVPGAAYALYGVWPLLLLLLALPPRAYAMDREVAASCGGAVFIGLALLTLSPHYKVFLAKLIWWLQYFITRTEAHLQVWIPPLNVRGGRDAIILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREILLGPADSLEGQGWRLLAPITAYAQQTRGLLGCIITSLTGRDKNQVEGEVQVVSTATQSFLATCINGVCWTVFHGAGSKTLAGPKGPVTQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQSFQVAHLHAPTGSGKSTRVPAAYAAQGYKVLVLNPSVAATLSFGAYMSKAHGVDPNIRTGVRTITTGAPITYSTYGKFLADGGCSGGAYDIIICDECHSTDSTSILGIGTVLDQAETAGARLVVLATATPPGSVTVPHPNIEEVALSNIGEIPFYGKAIPIETIKGGRHLIFCHSKKKCDELAAKLSGLGLNAVAYYRGLDVSVIPTSGDVVVVATDALMTGYTGDFDSVIDCNTCVIQTVDFSLDPTFTIETTTVPQDAVSRTQRRGRTGRGRGGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARSQAPPPSWDQMWKCLTRLKPTLHGPTPLLYRLGAVQNEVILTHPITKYIMACMSADLEIVTSTWVLVGGVLAALAAYCLTTGCVVIVGRIILSGKPAIIPDREVLYREFDEMEECASHLPYIEQGMQLAEQFKQKAIGLLQTATKQAEAAVPVVESKWRALEAFWAKHMWNFISGIQYLAGLSTLPGNPAIVSLMAFTASITSPLTTQHTLLFNILGGWVAAQLAPPRAASAFVGAGIVGAAVGSVGLGKVLVDVLAGYGAGVAGALVAFKIMSGEVPSTEDLVNLLPAILSPGALVVGVVCAAILRRHVGPGEGAVQWMNRLIAFASRGNHVSPTHYVPESDAAARVTQILSSLTITQLLRRLHQWINEDCSTPCSGSWLRDVWDWICTVLTDFKTWLQSKLMPRLPGVPFLSCQRGYRGVWRGDGIMHTTCPCGAQITGHVKNGSMRIVGPKTCSNTWHGTFPINAHTTGPCTPSPAPNYSRALWRVAAEEYVEVTRVGDFHYVTGMTTDNIKCPCQVPAPEFFTELDGVRLHRYAPACKPLLRDEVTFQVGLNQYPVGSQLPCEPEPDVTVLTSMLTDPSHITAETAKRRLARGSPPSLARSSASQLSAPSLKATCTTHHDSPDADLIEANLLWRQEMGGNITRVESENKVVILDSFDPLRAEEDEREVSVAAEILRKSRKFPPALPIWARPDYNPPLIESWKDPDYVPPLVHGCPLPPTKAPPIPPPRRKRTVVLTESTVSSALAELATKTFGSSESSAVDSGTATAPPDQPSDDGDAGSDVESYSSMPPLEGEPGDPDLNDGSWSTVSEEASEDVVCCSMSYSWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIHSVWKDLLEDTETPIDTTIMAKSEVFCVQPEKGGRKPARLIVYPDLGVRVCEKMALYDVVSTLPQAVMGSSYGFQYSPGQRVEFLVNAWKSKKCPMGFAYDTRCFDSTVTENDIRVEESIYQCCDLAPEARQAIKSLTERLYIGGPLTNSKGQSCGYRRCRASGVLTTSCGNTLTCYLKASAACRAAKLQDCTMLVCGDDLVVICDSAGTQEDAASLRVFTEAMTRYSAPPGDPPKPEYDLELITSCSSNVSVAHDASGKRVYYLTRDPTTPLARAAWETARHTPVNSWLGNIIMYAPTLWARMILMTHFFSILLAQEQLEKALDCQIYGATYSIEPLDLPQIIQRLHGLSAFTLHSYSPGEINRVAACLRKLGVPPLRVWRHRARSVRARLLSQGGRAATCGKYLFNWAVRTKLKLTPIPAASRLDLSGWFVAGYSGGDIYHSLSRARPRWFMWCLLLLSVGVGIYLLPNR

SEQ ID NO: 24 - protein, 3010 aa, Artificial Sequence
  Recombinant polypeptide
MSTNPKPQRKTKRNTNRRPQDVKFPGGGQIVGGVYLLPRRGPKLGVRATRKTSERSQPRGRRQPIPKARRPEGRTWAQPGYPWPLYGNEGMGWAGWLLSPRGSRPSWGPNDPRRRSRNLGKVIDTLTCGFADLMGYIPLVGAPLGGAARALAHGVRVLEDSVNYATGNLPGCSFSIFLLALLSCLTVPASAYEVRNASGVYHVTNDCSNSSIVYEAADVIMHTPGCVPCVREGNSSRCWVALTPTLAARNSSIPTTTIRRHVDLLVGAAAFCSAMYVGDLCGSVFLVSQLFTFSPRRYETVQDCNCSIYPGHVSGHRMAWDMMMNWSPTTALVVSQLLRIPQAVVDMVAGAHWGVLAGLAYYSMAGNWAKVLIVMLLFAGVDGHTHVTGGRVASSTQSLVSWLSQGPSQKIQLVNTNGSWHINRTALNCNDSLQTGFLAALFYTHRFNSSGCPERMASCRPIDKFAQGWGPITHVVPNISDQRPYCWHYAPQPCGIVPASQVCGPVYCFTPSPVVVGTTDRSGVPTYNWGENETDVLILNNTRPPRGNWFGCTWMNGTGFTKTCGGPPCNIGGAGNNTLICPTDCFRKHPEATYTKCGSGPWLTPRCMVDYPYRLWHYPCTVNFTVFKVRMYVGGVEHRLNAACNWTRGERCDLEDRDRSELSPLLLSTTEWQILPCSFTTLPALSTGLIHLHRNIVDVQYLYGIGSAVVSFAIKWEYVVLLFLLLADARVCACLWMMLLVAQAEAALENLVVLNAASVAGAHGILSFLVFFCAAWYIKGKLVPGAAYAFYGVWPLLLLLMALPARAYAMDREMAASCGGAVFVGLVLLTLSPYYKVFLARLIWWLQYFITRAEAHLQVWVPPLNVRGGRDAIILLTCAVHPELIFDITKLLLAILGPLMVLQAGITRVPYFVRAQGLIRACMLVRKAAGGHYVQMAFMKLAALTGTYVYNHLTPLQDWAHAGLRDLAVAVEPVIFSDMETKIITWGADTAACGDIISGLPVSARRGKEILLGPADSFGEQGWRLLAPITAYSQQTRGLLGCIVTSLTGRDRNQVEGEVQMVSTATQSFLATCVNGVCWTVYHGAGSKTLAGPKGPITQMYTNVDQDLVGWPAPPGARSMTPCTCGSSDLYLVTRHADVIPVRRRGDGRGSLLSPRPISYLKGSSGGPLLCPSGHVVGIFRAAVCTRGVAKAVDFIPVESMETTMRSPVYTDNSSPPAVPQTFQVAHLHAPTGSGKSTKVPAAYAAQGYKVLVLNPSVAATLGFGAYMSKAHGIDPNIRTGVRTITTGASITYSTYGKFLADGGCSGGAYDIIMCDECHSTDSTTILGIGTVLDQAETAGVRLTVLATATPPGSVTVPHSNIEEVALSNTGEIPFYGKAIPIEAIKGGRHLIFCHSRKKCDELAAKLSALGVNAVAYYRGLDVSVIPASGDVVVVATDALMTGFTGDFDSVIDCNTCVTQTVDFSLDPTFTIDTTTVPQDAVSRSQRRGRTGRGRRGIYRFVTPGERPSGMFDSVVLCECYDAGCAWYELTPAETTVRLRAYLNTPGLPVCQDHLEFWEGVFTGLTHIDAHFLSQTKQAGENFPYLTAYQATVCARAQAPPPSWDQMWKCLIRLKPTLHGPTPLLYRLGAVQNEVTLTHPITKFIMACMSADLEVVTSTWVLVGGVLAALAAYCLTTGSVVIVGRIILSGRPAVIPDREVLYQEFDEMEECATHLPYIEQGMQLAEQFKQKALGLLQTATKQAEAAAPVVESKWRALETFWAKHMWNFISGVQYLAGLSTLPGNPAIASLMAFTASVTSPLTTQSTLLFNILGGWVAAQLAPPSAASAFVGAGIAGAAVGSIGLGKVLVDILAGYGAGVAGALVAFKVMSGEMPSTEDLVNLLPAILSPGALVVGVVCAAVLRRHVGPGEGAVQWMNRLIAFASRGNHVSPTHYVPESDAAVRVTQILSSLTITQLLKRLHQWINEDCSTPCSGSWLKDVWDWICTVLSDFKTWLQSKLLPRLPGVPFFSCQRGYKGVWRGDGIMQTTCPCGAQIAGHVKNGSMRIVGPRTCSNTWHGTFPINAYTTGPCTPSPAPNYSKALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAEAAKRRLARGSPPSLASSSASQLSAPSLKATCTTRHDSPDADLIEANLLWRQEMGGNITRVESENKVVVLDSFEPLRAEEDEREVSVPAEILRKSRKFPRAMPIWARPDYNPPLLESWKDPDYVPPVVHGCPLPPAKAPPIPPPRRKKTVVLTESTVSSALAELATKTFGSSGSSAVDSGTATAPPDQASDDGDKGSDVESYSSMPPLEGEPGDPDLSDGSWSTVSEEAGEDVVCCSMSYTWTGALITPCAAEESKLPINPLSNSLLRHHSMVYSTTSRSASLRQKKVTFDRLQVLDDHYQDVLKEMKAKASTVKAKLLSIEEACKLTPPHSAKSKFGYGAKDVRSLSSKAVNHIRSVWKDLLEDTVTPIDTTIMAKNEVFCVQPEKGGRKPARLIVFPDLGVRVCEKMALYDVVSTLPQAVMGPSYGFQYSPKQRVEFLVNTWKSKKCPMGFSYDTRCFDSTVTESDIRVEESIYQCCDLAPEARQAIRSLTERLYVGGPLTNSKGQNCGYRRCRASGVLTTSCGNTLTCYLKATAACRAAKLQDCTMLVNGDDLVVICESAGTQEDAANLRVFTEAMTRYSAPPGDPPQPEYDLELITSCSSNVSVAHDATGKRVYYLTRDPTTPLARAAWETVRHTPVNSWLGNIIMYAPTLWARMVLMTHFFSILIAQEQLEKALDCQIYGACYSIEPLDLPQIIERLHGLSAFSLHSYSPGEINRVASCLRKLGVPPLRAWRHRARSVRAKLLSQGGRAAVCGKYLFNWAVKTKLKLTPIPAASQLDLSGWFVAGYSGGDIYHSVSRARPRWFMLCLLLLSVGVGIYLLPNR

SEQ ID NO: 25 - protein, 3010 aa, Artificial Sequence
  Recombinant polypeptide
MSTNPKPQRQTKRNTNRRPQDVKFPGGGQIVGGVYLLPRRGPKLGVRATRKTSERSQPRGRRQPIPKARRPEGRTWAQPGYPWPLYGNEGMGWAGWLLSPRGSRPSWGPNDPRRRSRNLGKVIDTLTCGFADLMGYIPLVGAPLGGVARALAHGVRVVEDGVNYATGNLPGCSFSIFLLALLSCLTTPASAYEVRNVSGIYHVTNDCSNSSIVYEAADVIMHTPGCVPCVREDNSSRCWVALTPTLAARNSSIPTTTIRRHVDLLVGAAALCSAMYVGDFCGSVFLVSQLFTFSPRQHETVQDCNCSIYPGHVSGHRMAWDMMMNWSPTTALVVSQLLRIPQAIVDMVAGAHWGVLAGLAYYSMAGNWAKVLIVMLLFAGVDGHTHVTGGRVASSTQSLVSWLSQGPSQKIQLVNTNGSWHINRTALNCNDSLQTGFLAALFYTHKFNASGCPERMASCRPIDKFAQGWGPITYAGSCGLDQRPYCWHYAPQPCGIVPAAQVCGPVYCFTPSPVVVGTTDRFGAPTYNWGENETDVLILNNTRPPQGNWFGCTWMNSTGFTKTCGAPPCNIGGVGNNTLTCPTDCFRKHPDATYTKCGSGPWLTPRCMVDYPYRLWHYPCTVNFTVFKVRMYVGGVEHRLNAACNWTRGERCDLEDRDRSELSPLLLSTTEWQILPCAFTTLPALSTGLIHLHRNIVDVQYLYGVGSAVVSFAIKWEYILLLFLLLADARVCACLWMMLLIAQAEATLENLVVLNAASVAGTHGILPFLVFFCAAWYIKGRLVPGAAYALYGVWPLLLLLLALPPRAYAMDREVAASCGGAVFVGLVLLTLSPYYKVFLARLIWWLQYFITRAEAHLQVWVPPLNVRGGRDAIILLMCVVHPELIFDITKLLLAILGPLMVLQAGITRVPYFVRAQGLIRACMLVRKVVGGHYVQMAFMKLAALTGTYVYDHLTPLQDWAHAGLRDLAAAVEPVVFSDMETKIITWGAETAACGDIISGLPVSARRGKEILLGPADSFGEQGWRLLAPITAYSQQTRGLLGCIITSLTGRDKNQVDGEVQVLSTATQSFLATCINGVCWTVYHGAGSKTLAGPKGPITQMYTNVDQDLVGWPAPPGARSMTPCTCGSSDLYLVTRHADVIPVRRRGDNRGSLLSPRPVSYLKGSSGGPLLCPSGHVVGIFRAAVCTRGVAKAVDFVPVESMETTMRSPVFTDNSSPPAVPQTFQVSHLHAPTGSGKSTKVPAAYASQGYKVLVLNPSVAATLGFGAYMSKAYGVDPNIRTGVRTITTGASITYSTYGKFLADGGCSGGAYDIIICDECHSTDATTILGVGTVLDQAETAGARLVVLATATPPGSVTVPHSNIEEVALSNTGEIPFYGKAIPIEAIKGGRHLIFCHSKKKCDELATKLSALGINAVAYYRGLDVSVIPTSGDVVVVATDALMTGFTGDFDSVIDCNTCVVQTVDFSLDPTFTIETTTVPQDAVSRTQRRGRTGRGRRGIYRFVTPGERPSGMFDSVVLCECYDAGCAWYELTPAETTVRLRAYLNTPGLPVCQDHLEFWEGVFTGLTHIDAHFLSQTKQAGDNFPYLTAYQATVCARAQAPPPSWDQMWKCLTRLKPTLHGPTPLLYRLGAVQNEVTLTHPITKYIMTCMSADLEVVTSTWVLVGGVLAALAAYCLTTGCVVIVGRIILSGKPAVIPDREALYQEFDEMEECATHLPYIEQGMQLAEQFKQKALGLLQTASKQAEAAAPVVESKWRALEAFWAKHMWNFISGVQYLAGLSTLPGNPAIASLMAFTASVTSPLTTQSTLLFNILGGWVAAQLAPPSAASAFVGAGIAGAAIGSIGLGKVLVDILAGYGAGVAGALVAFKVMSGDMPSTEDLVNLLPAILSPGALVVGVVCAAILRRHVGPGEGAVQWMNRLIAFASRGNHVSPTHYVPESDAAARVTQILSSLTITQLLRRLHQWINEDCSTPCSGSWLKDVWDWICTVLADFKTWLQSKLLPRLPGLPFLSCQRGYKGVWRGDGVMQTTCPCGAQISGHVKNGSMRIVGPRTCSNTWHGTFPINAYTTGPCTPSPAPNYSRALWRVAAEEYVEITRVGDFHYVTGMTTDNVKCPCQVPAPEFFTEVDGVRLHRYAPACRPLLREEVVFQVGLNQYPVGSQLPCEPEPDVTVVTSMLTDPSHITAEAAKRRLARGSPPSLASSSASQLSALSLKATCTTRHDSPDVDLIEANLLWRQEMGGNITRVESENKVVILDSFEPLQAEEDEREVSVAAEILRKSRKFPPAMPVWARPDYNPPLLESWKDPDYVPPVVHGCPLPPTKAPPIPPPRRKKTVVLTESTVSSALAELATKTFGSSGSSAVDSGTATAPPDQASDDGDKGSDVESYSSMPPLEGEPGDPDLSDGSWSTVSGEAGEDVVCCSMSYTWTGALITPCAAEESKLPINPLSNSLLRHHSMVYSTTSRSASLRQKKVTFDRLQVLDDHYRDVLKEMKAKASTVKAKLLSIEEACKLTPPHSAKSKFGYGAKDVRNLSSRAVNHIRSVWEDLLEDTETPIDTTIMAKSEVFCVQPEKGGRKPARLIVYPDLGVRVCEKMALYDVVSTLPQAVMGPSYGFQYSPGQRVEFLVNAWKSKKCPMGFAYDTRCFDSTVTENDIRTEESIYQCCDLDPEARQAIRSLTERLYVGGPLTNSKGQNCGYRRCRASGVLTTSCGNTLTCYLKATAACRAAKLQDCTMLVNGDDLVVICESAGTQEDAANLRVFTEAMTRYSAPPGDLPQPEYDLELITSCSSNVSVAHDAAGKRVYYLTRDPTTPLARAAWETVRHTPVNSWLGNIIMYAPTLWARMVLMTHFFSILIAQEQLEKALDCQIYGACYSIEPLDLPQIIERLHGLSAFSLHSYSPGEINRVASCLRKLGVPPLRTWRHRARSVRAKLLSQGGRAAICGRYLFNWAVRTKLKLTPIPAASRLDLSGWFVAGYGGGDIYHSLSRARPRWFMLCLLLLSVGVGIYLLPNR

SEQ ID NO: 26 - protein, 3010 aa, Artificial Sequence
  Recombinant polypeptide
MSTNPKPQRKTKRNTNRRPQDVKFPGGGQIVGGVYLLPRRGPRLGVRAPRKTSERSQPRGRRQPIPKARRPEGRAWAQPGYPWPLYGNEGLGWAGWLLSPRGSRPSWGPSDPRRRSRNLGKVIDTLTCGFADLMGYIPLVGAPLGGAARALAHGVRVLEDSVNYATGNLPGCSFSIFLLALLSCLTIPASAYEVRNASGVYHVTNDCSNASIVYEAADMIMHTPGCVPCVRENNSSRCWVALTPTLAARNASVPTTTIRRHVDLLVGTAAFCSAMYVGDLCGSVFLVSQLFTFSPRRHETVQDCNCSIYPGHVTGHRMAWDMIMNWSPTTALVVSQLLRIPQAVVDMVAGAHWGILAGLAYYSMVGNWAKVLVVMLLFAGVDGGTHVTGGKVAYTTQGFTSFFSRGPSQKIQLVNTNGSWHINRTALNCNDSLNTGFLAALFYTHRFNSSGCPERMASCRSIDKFDQGWGPITYAEPGSSDQRPYCWHYAPKPCGIVPASQVCGPVYCFTPSPVVVGTTDRFGVPTYSWGENETDVLLLNNTRPPQGNWFGCTWMNGTGFTKTCGGPPCNIGGAGNNTLICPTDCFRKHPEATYTKCGSGPWLTPRCLVDYPYRLWHYPCTVNFTIFKVRMYVGGVEHRLEAACNWTRGERCNLEDRDRSELSPLLLSTTEWQILPCSFTTLPALSTGLIHLHQNVVDVQYLYGIGSAVVSFAIKWEYVLLLFLLLADARICACLWMMLLIAQAEAALENLVVINAASVAGAHGFLSFLVFFCAAWYIKGRLVPGAAYAIYGVWPLFLLLLALPPRAYAMDREMAASCGGAVFVGLALLTLSPHYKVFLAKLIWWLQYLITRAEALLQVWVPPLNVRGGRDAIILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGKEIFLGPADSLEGQGWRLLAPITAYAQQTRGLLGCIVTSLTGRDRNQVEGEVQVVSTATQSFLATCVNGVCWTVYHGAGTKTLAGPKGPIIQMYTNVDQDLVGWQAPPGARSLTPCTCGSSDLYLVTRHADVIPVRRRGDGRGSLLSPRPISYLKGSSGGPLLCPLGHVVGIFRAAVCTRGVAKAVDFIPVESLETTMRSPVYTDNSSPPAVPQSFQVAHLHAPTGSGKSTKVPAAYAAQGYKVLVLNPSVAATLGFGAYMSKAHGIDPNIRTGVRTITTGAPVTYSTYGKFLADGGCSGGAYDIIMCDECHSTDSTTILGIGTVLDQAETAGARLVVLATATPPGSVTVPHPNIEEVALSNIGEIPFYGKAIPIETIKGGRHLIFCHSRKKCDELAAKLSGLGLNAVAYYRGLDVSVIPASGDVVVVATDALMTGFTGDFDSVIDCNTCVIQTVDFSLDPTFTIDTTTVPQDAVSRSQRRGRTGRGRMGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARSQAPPPSWDQMWKCLIRLKPTLHGSTPLLYRLGAVQNEVILTHPITKYIMACMSADLEVATSTWVLVGGVLAALAAYCLTAGSVVIVGRIILSGKPAIIPDREVLYREFDEMEECASQLPYIEQGMQLAEQFKQKAIGLLQTATKQAEAAVPVVESKWRTLEAFWAKHMWNFISGIQYLAGLSTLPGNPAIVSLMAFTASITSPLTTQHTLLFNILGGWVAAQLAPPRAASAFVGAGIAGAAVGSIGLGKVLVDVLAGYGAGVAGALVAFKVMSGEMPSTEDLVNLLPAILSPGALVVGVVCAAILRRHVGPGEGAVQWMNRLIAFASRGNHVSPTHYVPESDAAVRVTQILSSLTITQLLKRLHRWINEDCSTPCAGSWLRDVWDWICTVLTDFKTWLQSKLLPRLPGVPFFSCQRGYKGVWRGDGIMHTTCPCGAQIAGHVKNGSMKIVGPKTCSNTWHGTFPINAHTTGPCTPSPAPNYSKALWRVAAEEYVEVTRVGDFHYVTGMTTDNLKCPCQVPAPEFFTELDGVRLHRYAPACKPLLREEVTFQVGLNQYLVGSQLPCEPEPDVAVLTSMLTDPSHITAETARRRLARGSPPSLASSSASQLSAPSLKATCTTRHDSPDADLIEANLLWRQEMGGNITRVESENKVVVLDSFEPLRAEEDEREVSVPAEILRKSRKFPRAMPIWARPDYNPPLIESWKDPDYAPPVVHGCPLPPTKTPPIPPPRRKRTVVLTESTVSSALAELATKTFGSSESSAADSGTATAPPDQPSDDGDAGSDVESYSSMPPLEGEPGDPDLSDGSWSTVSEEAGEDVVCCSMSYSWTGALITPCAAEETKLPINALSNSLLRHHNLVYATTSRSAGLRQKKVTFDRLQVPDDHYRDVLKDMKAKASTVKAKLLSVEEACRLTPPHSARSKFGYGAKDVRSLSSKAVNHIRSVWKDLLEDTDTPIDTTIMAKNEVFCIQPEKGGRKPARFIVFPDLGVRVCEKMALYDVVSTLPQAVMGSSYGFQYSPKQRVEFLVNTWKSKKCPMGFSYDTRCFDSTVTESDIRVEESIYQCCDLAPEARQAIRSLTERLYIGGPLTNSKGQSCGYRRCRASGVLTTSCGNTLTCYLKAAAACRAAKLRDCTMLVCGDDLVVICESAGTQEDEASLRAFTEAMTRYSAPPGDPPKPEYDLELITSCSSNVSVAHDASGKRVYYLTRDPATPLARAAWETARSTPVNSWLGNIIMYAPTLWARMILMTHFFSILLVQEQLEKALDCQIYGAYYSIEPLDLPQIIERLHGLSAFSLHSYSPGEINRVAACLRKLGVPPLRVWRHRARSVRARLLSQGGRAATCGKYLFNWAVRTKLKLTPIPAASQLDLSSWFVAGYSGGDIYHSLSRARPRWFMFCLLLLSVGVGVYLLPNR

SEQ ID NO: 27 - protein, 3010 aa, Artificial Sequence
  Recombinant polypeptide
MSTNPKPQRKIKRNTNRRPQDVKFPGGGQIVGGVYLLPRRGPRLGVRATRKTSERPQPRGRRQPIPKARQPEGRAWAQPGYPWPLYGNEGCGWAGWLLSPRGSRPSWGPTDPRRRSRNLGKVIDTLTCGLADLMGYIPLVGGPLGGAARALAHGVRVLEDGVNYATGNLPGCSFSIFLLALLSCLTVPASAYEVRNVSGVYHVTNDCSNSSIVYETADMIMHTPGCVPCVREGNSSRCWVALTPTLAARNASVPTTAIRRHVDLLVGAAAFCSAMYVGDLCGSVFLISQLFTFSPRRYETVQDCNCSLYPGHITGHRMAWDMMMNWSPTAALVVSQLLRIPQAVVDIVAGAHWGILAGLAYYSMVGNWAKVLIVLLLFAGVDGNTRVSGGEAAKNTMGFASLFVSGPSQKIQLINTNGSWHINRTALNCDDSLHTGFLAALFYAHKFNSSGCSGRMASCRPIDEFAQGWGPITHGVPDNLDQRPYCWHYAPRPCGIVPASEVCGPVYCFTPSPVVVGTTDRSGVPTYTWGENETDVLLLNNTRPPRGNWFGCTWMNGTGFTKTCGGPPCNIGGVGNDTLICPTDCFRKHPEATYAKCGSGPWLTPRCIVDYPYRLWHYPCTVNFSIFKVRMYVGGVEHRLDAACNWTRGERCDLEDRDRTELSPLLLSTTEWQVLPCSFTTLPALSTGLIHLHQNIVDVQYLYGIGSVVVSFAIKWEYVVLLFLLLADARFCACLWMMLLVAQAEAALENLVVLNAASVAGAHGILSFLVFFCAAWYIKGKLVPGAAYAFYGVWPLLLLLMALPPRAYALDREMAASCGGAVFIGLALLTLSPHYKAFLARLIWWLQYLITRAEAHLQVWIPPLNVRGGRDAIILLTCAVHPELIFEITKILLAIFGPLMVLQAGLTRVPYFVRAQGLIRACMLVRKAAGGHYVQMALMRLAALTGTYVYNHLTPLRDWAHTGLRDLAVAVEPVIFSDMETKIITWGADTAACGDILSGLPVSARRGREILLGPADSFEGQGWRLLAPITAYSQQTRGLFGCIITSLTGRDKNQVEGEVQVVSTATQSFLATCVNGVCWTVFHGAGSKTLAGPKGPVTQMYTNVDQDLVGWQAPSGARSLTPCTCGSSDLYLVTRHADVIPVRRRGDSRGSLLSPRPISYLKGSSGGPLLCPSGHAVGIFRAAVCTRGVAKAVDFIPVESMETTMRSPVFTDNSTPPAVPQTFQVAHLHAPTGSGKSTRVPAAYAAQGYKVLVLNPSVAATLSFGAYMSKAHGVDPNIRTGIRTITTGAPITYSTYGKFLADGGCSGGAYDIIICDECHSTDSTSILGIGTVLDQAETAGARLVVLATATPPGSITVPHPNIEEVALPNTGEIPFYGKAIPIEVIKGGRHLIFCHSKKKCDELAAKLSALGVNAVAYYRGLDVSVIPTSGNVVVVATDALMTGYTGDFDSVIDCNTCVTQTVDFSLDPTFTIETTTLPQDAVSRSQRRGRTGRGRGGIYRFVTPGERPSGMFDSSVLCECYDAGCAWYELTPAVTSVRLRAYLNTPGLPVCQVHLEFWESVFTGLTHIDAHFLSQTKQAGENFPYLVAYQATVCARAKAPPPSWDQMWKCLIRLKPTLHGPTPLLYRLGAVQNEITLTHPITKFIMACMSADLEVVTSTWVLVGGVLAALAAYCLTTGSVVIVGRIILSGRPAVIPDREVLYQEFDEMEECASHLPYIEQGVQLAEQFKQKALGLLQTATKQAEAAAPMVESKWRALETFWAKHMWNFISGIQYLAGLSTLPGNPPIASLMAFTASITSPLTTQNTLLFNILGGWVAAQLAPPSAASAFVGAGIVGAAVGSVGLGKVLVDILAGYGAGVAGALVAFKIMSGEVPSTEDLVNLLPAILSPGALVVGVVCAAVLRRHVGPGEGAVQWMNRLIAFASRGNHVSPTHYVPESDAAARVTQILSNLTITQLLKRLHQWINEDCSTPCSGSWLRDVWDWICTVLSDFKTWLQSKLLPRLPGVPFLSCQRGYRGVWRGDGIMQTTCPCGAQITGHVKNGSMRIVGPKTCSNTWRGSFPINAYTTGPSTPSPAPNYTFALWRVSAEEYVEVRRLGDFHYVTGMTTDNIKCPCQVPAPEFFTELDGVRLHRYAPACKPLLRDEVTFQVGLNQYVVGSQLPCEPEPDVTVLTSMLTDPSHITAETAKRRLARGSPPSLARSSASQLSAPSLKATCTTHHDSPDADLIEANLLWRQEMGGNITRVESENKVVILDSFDPLRAEEDEREISVPAEILRKTRKFPPALPIWARPDYNPPLLESWRDPDYVPPVVHGCPLPPAKAPPVPPPRRKRTVVLSESTVSSALAELATKTFGSSESSAVDSGTATAPPDQPSDNGDTGSDVESYSSMPPLEGEPGDPDFSDGSWSTVSEEASEDVVCCSMSYTWTGAMITPCAAEESKLPINALSNSLLRHHNMVYATTSRSASQRQKKVTFDRLQVLDNHYQDVLKEMKAKASTVKARLLSVEEACKLTPPHSARSKFGYGAKDVRNLSSKAVNHIHSVWKDLLEDTETPIDTTVMAKNEVFCVQPEKGGRKPARLIVFPDLGVRVCEKMALYDVVSNLPQAVMGSAYGFQYSPGQRVEFLVNAWKSKKNPMGFAYDTRCFDSTVTENDIRVEESIYQSCDLAPEARQAIKSLTERLYIGGPLTNSKGQNCGYRRCRVSGVLTTSCGNTLTCYLKASAACRAAKLQDCTMLVCGDDLVVICDSAGTQEDAASLRVFTEAMTRYSAPPGDPPQPEYDLELITSCSSNVSVAHDATGKRVYYLTRDPTTPIARAAWETARHTPVNSWLGNIIMYAPTLWVRMILMTHFFSILLAQEQLEKALDCQIYGATYSIEPLDLPQIIQRLHGLSAFSLHSYSPGEINRVASCLRKLGVPPLRAWRHRARSVRAKLLSRGGRAATCGRYLFNWAVKTKLKLTPIPAASQLDLSGWFVAGYSGGDIYHSVSRARPRWFMWCLLLLSVGVGIYLLPNR

SEQ ID NO: 28 - protein, 3014 aa, Artificial Sequence
  Recombinant polypeptide
MSTNPKPQRKTKRNTNRRPQDVKFPGGGQIVGGVYLLPRRGPRLGVRATRKTSERPQPRGRRQPIPKARQPEGRAWAQPGYPWPLYGNEGLGWAGWLLSPRGSRPSWGPNDPRRRSRNLGKVIDTLTCGFADLMGYIPLVGAPLGGAARALAHGVRVLEDSVNYATGNLPGCSFSIFLLALLSCLTVPASAYEVRNVSGVYHVTNDCSNSSIVYEAADIIMHTPGCVPCVRENNSSRCWVALTPTLAARNASVPTTTIRRHVDLLVGAAAFCSAMYVGDLCGSIFLVGQLFTLSPRRHWTTQDCNCSIYPGHVTGHRMAWDMMMNWSPTTALVLSQLLRIPQAVVDMVAGAHWGILAGLAYYSMAGNWAKVLIVMLLFAGVDGGTHVTGGKVAYTTQGFTSFFSRGPSQKIQLVNTNGSWHINRTALNCNDSLNTGFLAALFYTHRFNSSGCPERMASCSPIDAFAQGWGPITYNESHSSDQRPYCWHYPPQPCGIVPAAQVCGPVYCFTPSPVVVGTTDRFGVPTYTWGENETDVLLLNNTRPPRGNWFGCTWMNSTGFTKTCGGPPCKIGGVGNNTLTCPTDCFRKHPEATYTRCGSGPWLTPRCLVHYPYRLWHYPCTVNFTIFKVRMYVGGVEHRLEAACNWTRGERCNLEDRDRSELSPLLLSTTEWQILPCSYTTLPALSTGLIHLHQNTVDVQYLYGIGSVVVSFAIKWEYVLLLFLLLADARVCACLWMMLLIAQAEAALENLVVLNAASLAGAHGILSFLVFFCAAWYIKGRLVPGAAYAFYGVWPLFLLLLALPPRAYALDREMAASCGGAVFVGLALLTLSPHYKLFLARLIWWLQYFITRAEAHLQVWIPPLNVRGGRDAIILLTCAIHPELIFTITKILLAILGPLMVLQAGITKVPYFVRAHGLIRACMLVRKVAGGHYVQMALMKLAALTGTYVYDHLTPLRDWAHTGLRDLAVAVEPVIFSDMETKVITWGADTAACGDIILGLPVSARRGKEIFLGPADSLEGQGWRLLAPITAYAQQTRGLLGCIITSLTGRDRNQVEGEVQVVSTATQSFLATCVNGVCWTVFHGAGSKTLAGAKGPITQMYTNVDQDLVGWQAPSGARSLTPCTCGSSDLYLVTRHADVIPVRRRGDGRGSLLSPRPVSYLKGSSGGPLLCPLGHAVGIFRAAVCTRGVAKAVDFIPVESMETTMRSPVYTDNSSPPAVPQSFQVAHLHAPTGSGKSTKVPAAYAAQGYKVLVLNPSVAATLGFGAYMSKAHGIDPNIRTGVRTITTGGPITYSTYGKFLADGGCSGGAYDIIICDECHSTDSTTILGIGTVLDQAETAGARLVVLATATPPGSITVPHPNIEEVALSNIGEIPFYGKAIPIETIKGGRHLIFCHSKKKCDELAAKLSGLGLNAVAYYRGLDVSVIPTSGDVVVVATDALMTGYTGNFDSVIDCNTCVTQTVDFSLDPTFTIETTTLPQDAVSRSQRRGRTGRGRMGIYRFVTPGERPSGMFDSVVLCECYDAGCAWYELTPAETSVRLRAYLNTPGLPVCQDHLEFWEGVFTGLTHIDAHFLSQTKQAGDNLPYLVAYQATVCARAQAPPPSWDQMWKCLTRLKPTLHGPTPLLYRLGAVQNEVTLTHPVTKYIMACMSADLEVVTSTWVLVGGVLAALAAYCLTTGCVVIVGRIILSGKPAIIPDREVLYQEFDEMEECASHLPYIEHGMHLAEQFKQKAIGLLQTATKQAEAAAPVVESKWRTLEAFWAKHMWNFISGIQYLAGLSTLPGNPAIVSLMAFTASITSPLTTQHTLLFNILGGWVAAQLAPPSAASAFVGAGIAGAAIGSIGLGKVLVDILAGYGAGVAGALVAFKIMSGEAPSTEDLVNLLPAILSPGALVVGIVCAAILRRHVGPGEGAVQWMNRLIAFASRGNHVSPTHYVPESDAAARVTQILSSLTITQLLKRLHQWISEDCSTPCSGSWLRDIWDWICTVLTDFRTWLQSKLLPRLPGVPFLSCQRGYRGVWRGDGIMHTTCPCGAQISGHVKNGSMRIVGPRTCSNTWHGTFPINAHTTGPCTPSPAPNYSTALWRVAAEEYVEVRRVGDFHYVTGMTTDNIKCPCQVPAPEFFTEVDGIRLHRYAPACKPLLREEVTFQVGLNQYLVGSQLPCEPEPDVSVLTSMLTDPSHITAETARRRLARGSPPSLASSSASQLSAPSLRATCTTHSSYNLDSPDVDLIEANLLWRQEMGGNITRVESENKIVILDSFDPLRAEEDEREVSVPAEILRRSRKFPPAMPIWARPDYNPPLLEPWKDPDYVPPVVHGCPLPPAKAPPIPPPRRKRTVVLSESTVSSALAELATKTFSSSESSAVDSGTATAPPDQPSDDGDAGSDVESYSSMPPLEGEPGDPDLSDGSWSTVSEEASEDVVCCSMSYTWTGALITPCAAEETKLPINALSNSLLRHHNLVYATTSRSASQRQRKVTFDRLQVPDDHYRDVLKEMKAKASTVKAKLLSIEEACKLTPPHSAKSKYGYGAKDVRSLSSKAVNHIRSVWKDLLEDTETPIDTTVMAKNEVFCVQPEKGGRKAARLIVFPDLGVRVCEKMALYDVVSTLPQAVMGSAYGFQYSPGQRVEFLVNAWKSKKSPMGFAYDTRCFDSTVTESDIRTEESIYQCCDLAPEARQVIRSLTERLYIGGPLTNSKGQNCGYRRCRASGVLTTSCGNTLTCYLKAAAACRAAKLQDCTMLVCGDDLVVICESAGTQEDEASLRAFTEAMTRYSAPPGDPPKPEYDLELITSCSSNVSVAHDATGKRVYYLTRDPTIPLARAAWETAKHTPVNSWLGNIIMYAPTLWVRMILMTHFFSILLVQEQLEKALDCQIYGAYYSIEPLDLPQIIERLHGLSAFSLHSYSPGEINRVASCLRKLGVPPLRTWRHRARSVRAKLLSQGGRAAICGRYLFNWAVRTKLKLTPISAASQLDLSSWFVAGYSGGDIYHSLSRARPRWFMFCLLLLSVGVGVYLLPNR

SEQ ID NO: 29 - protein, 3010 aa, Artificial Sequence
  Recombinant polypeptide
MSTNPKPQRKIKRNTNRRPQDVKFPGGGQIVGGVYLLPRRGPRLGVRAPRKTSERSQPRGRRQPIPKARRPEGRTWAQPGYPWPLYGNEGCGWAGWLLSPRGSRPSWGPTDPRRRSRNLGKVIDTLTCGLADLMGYIPLVGAPLGGAAKALAHGVRVLEDGVNYATGNIPGCSFSIFLLALLSCLTTPASAYEVRNASGAYHVTNDCSNSSIVYETADMIMHTPGCVPCVREGNSSRCWVALTPTLAARNASIPTTAIRRHVDLLVGTAAFCSAMYVGDLCGSVFLVSQLFTFSPRRHVTLQDCNCSIYPGHVSGHRMAWDMIMNWSPTTALVVSQLLRIPQAIVDMVAGAHWGVLVGLAYYSMVGNWAKVLVVMLLFAGVDGTTHVSGAQAGHATRSFTSLFTLGASQKVQLINTNGSWHINRTALNCNDSLQTGFLAALFYTHKFNASGCPERMASCRSIDKFDQGWGPITYAEPHDLDQRPYCWHYAPRPCGIVPASEVCGPVYCFTPSPVVVGTTDRSGAPTYRWGENETDVLLLNNTRPPHGNWFGCTWMNSTGFTKTCGGPPCNIGGAGNNTLTCPTDCFRKHPEATYTRCGSGPWLTPRCMVDYPYRLWHYPCTFNFTIFKIRMYVGGVEHRLDAACNWTRGERCDLDDRDRSELSPLLLSTTEWQILPCSFTTLPALSTGLIHLHQNVVDVQYLYGIGSAVVSFVIKWEYVVLLFLLLADARICACLWMMLLIAQAEAALENLVVLNAASVAGAHGFLSFLVFFCAAWYVKGRLVPGAAYALYGVWPLLLLLLALPPRAYAMDREMAASCGGAVFIGLALLTLSPYYKVFLAKLIWWLQYFITRAEAHLHVWVPPLNVRGGRDAIILLMCAVHPELIFDITKILLAIFGPLMVLQAGLTRVPYFVRAQGLIRVCMLVRKVAGGHYIQMALMKLAALTGTYVYNHLTPLRDWAHAGLRDLVVAVEPVVFSDMETKIITWGADTAACGDIILGLPVSARRGREILLGPADSLEGRGWRLLAPITAYAQQTRGLFGCIITSLTGRDKNQVEGEVQVVSTATQSFLATCINGVCWTVYHGAGTKTLAGPKGPVTQMYTNVDQDLVGWQAPPGARSLSPCTCGSSDLYLVTRHADVIPVRRRGDNRGSLLSPRPVSYLKGSSGGPLLCPSGHAVGIFRAAVCTRGVAKAVDFVPVESMETTTRSPVFTDNSSPPAVPQTFQVSHLHAPTGSGKSTKVPAAYATQGYKVLVLNPSVAATLGFGAYMSKAYGTDPNIRTGVRTITTGAPITYSTYGKFLADGGCSGGAYDIIMCDECHSTDSTSILGIGTVLDQAETAGARLVVLATATPPGSVTVPHPNIEEIALSNTGEIPFYGKAIPIEAIKGGRHLIFCHSRKKCDELAAKLSGLGINAVAYYRGLDVSVIPASGNVVVVATDALMTGFTGDFDSVIDCNTCVVQTVDFSLDPTFTIDTTTVPQDAVSRSQRRGRTGRGRRGIYRFVTPGERPSGMFDSSVLCECYDAGCAWYELTPAETTVRLRAYLNTPGLPVCQDHLEFWEGVFTGLTHIDAHFLSQTKQAGENFPYLTAYQATVCARALAPPPSWDQMWKCLVRLKPTLHGPTPLLYRLGAVQNEVILTHPITKYIMACMSADLEVVTSTWVLVGGVLAALAAYCLTAGSVVIVGRIVLSGRPAVVPDREVLYREFDEMEECASQLPYIEQGMQLAEQFRQKALGLLQTATKQAEAAVPVVESKWRALEAFWAKHMWNFISGVQYLAGLSTLPGNPAIASLMAFTASITSPLTTQYTLLFNILGGWVAAQLAPPSAASAFVGAGIAGAAVGSIGLGKVLVDVLAGYGAGVAGALVAFKVMSGEVPSTEDLVNLLPAILSPGALVVGVVCAAILRRHVGPGEGAVQWMNRLIAFASRGNHVSPTHYVPESDAAVRVTQILSSLTITQLLRRLHQWINEDCSTPCSGSWLRDVWDWICTVLTDFKTWLQSKLLPRLPGIPFFSCQRGYRGVWRGDGVMQTTCPCGAQIAGHVKNGSMKIVGPKTCSNTWHGTFPINAYTTGPCTPSPAPNYTRALWRVAAEDYVEVTRVGDFHYVTGMTTDNVKCPCQVPAPEFFSEVDGVRLHRYAPACRPLLREEVTFQVGLNQYVVGSQLPCEPEPDVTVLTSMLTDPSHITAEAAKRRLARGSPPSLASSSASQLSAPSLKATCTTRHDSPDADLIEANLLWRQEMGGNITRVESENKVVILDSFEPLRAEEDEREISVPAEILRKSRKFPRAMPIWARPDYNPPLIESWKDPDYAPPVVHGCPLPPTKAPPIPPPRRKRTVVLTESTVSSALAELATKTFGSSESSAVDSGTASAPPDQPSDNGDTGSDVESYSSMPPLEGEPGDPDLSDGSWSTVSGEAGEDVVCCSMSYTWTGALITPCAAEENKLPINALSNSLLRHHNMVYATTSRSAGLRQKKVTFDRQQVLDDHYRDVLKEIKAKASTVKAKLLSVEEACKLTPPHSARSKFGYGAKDVRNLSSKAVNHIHSVWKDLLEDTVTPIDTTIMAKNEVFCVQPEKGGRKPARFIVFPDLGVRVCEKMALYDVVSTLPQAVMGASYGFQYSPSQRVEFLVNAWKSKKNPMGFAYDTRCFDSTVTESDIRVEESIYQCCDLAPEARQAIKSLTERLYIGGPMTNSKGQNCGYRRCRASGVLTTSCGNTITCYLKASAACRAAKLQDCTMLVNGDDLVVICESAGTQEDAAALRAFTEAMTRYSAPPGDPPRPEYDLELITSCSSNVSVAHDASGKRVYYLTRDPTTPLARAAWETARHTPINSWLGNIIMYAPTLWARMVLMTHFFSILIAQEQLEKALDCQIYGACYSIEPLDLPQIIERLHGLSAFTLHSYSPGEINRVASCLRKLGVPPLRVWRHRARSVRARLLSQGGRAATCGKYLFNWAVRTKLKLTPIPAASRLDLSGWFVAGYGGGDIYHSLSRARPRWFMLCLLLLSVGVGVYLLPNR

SEQ ID NO: 30 - protein, 3010 aa, Artificial Sequence
  Recombinant polypeptide
MSTNPKPQRQTKRNTNRRPQDVKFPGGGQIVGGVYLLPRRGPKLGVRATRKTSERSQPRGRRQPIPKARHPEGRAWAQPGYPWPLYGNEGMGWAGWLLSPRGSRPNWGPTDPRRRSRNLGKVIDTLTCGFADLMGYIPLVGAPLGGVARALAHGVRVVEDGVNYATGNLPGCSFSIFLLALLSCLTIPASAHEVRNASGVYHVTNDCSNSSIVYEAADVIMHTPGCVPCVREDNSSRCWVALTPTLAARNSSVPTTTIRRHVDLLVGAAAFCSVMYVGDLCGSVFLISQLFTFSPRRYETVQDCNCSLYPGHVSGHRMAWDMMMNWSPTTALVVSQLLRIPQAVMDMVAGAHWGVLAGLAYYSMVGNWAKVLIVLLLFAGVDGNTRVSGGEAAKNTMGFASLFVSGPSQKIQLINTNGSWHINRTALNCNDSLHTGFLAALFYAHKFNSSGCPERMASCRPIDEFAQGWGPITHGVPDNLDQRPYCWHYAPQPCGTIPAAQVCGPVYCFTPSPVVVGTTDRFGAPTYNWGENETDVLILNNTRPPQGNWFGCTWMNSTGFTKTCGAPPCNIGGVGNNTLVCPTDCFRKHPEATYTKCGSGPWLTPRCLVDYPYRLWHYPCTVNFSIFKVRMYVGGVEHRLSAACNWTRGERCNVEDRDRSELSPLLLSTTEWQVLPCSFTTLPALSTGLIHLHQNIVDVQYLYGVGSAVVSVAIRWEYVVLLFLLLADARFCACLWMMLLVAQAEAALENLVVLNAASVAGAHGILPFLVFFCAAWYIKGKLVPGAAYAIYGVWPLLLLLLTLPPRAYAMDREVAASCGGAVFVGLVLLTLSPHYKVFLARLIWWLQYLITRAEALLQVWVPPLNVRGGRNAIILLTCVVHPELIFEITKTLLAILGPLTVLQVGLTKVPYFVRAQGLIRACMLVRKAAGGHYVQMAFVKLAALTGTYVYDHLTPLQDWAHAGLRDLAVAVEPVVFSAMETKIITWGAETAACGDIISSLPVSARRGRELLLGPADSFEGQGWRLLAPITAYAQQTRGLLGCIVTSLTGRDKNQVEGEAQVVSTATQSFLATCINGACWTVFHGAGSKTLAGPKGPIIQMYTNVDQDLVGWAAPPGARSLTPCTCGSSDLYLVTRHADVIPVRRRGDSRGSLLSPGPISYLKGSSGGPLLCPSGHAVGVFRAAVCTRGVAKAVDFVPVESMETTMRSPVFTDNSTPPAVPQTFQVAHLHAPTGSGKSTKVPAAYAAQGYKVLVLNPSVAATLGFGAYMSKAHGVDPNIRTGVRTITTGASITYSTYGKFLADGGCSGGAYDIIMCDECHSTDATTILGVGTVLDQAETAGARLVVLATATPPGSVTVPHSNIEEVALSNTGEIPFYGKAIPLETIKGGRHLIFCHSRKKCDELAAKLSALGVNAVAYYRGLDVSVIPASGDVVVVATDALMTGYTGDFDSVIDCNTCVTQTVDFSLDPTFTIETTTLPQDAVSRAQRRGRTGRGRAGIYRFVTPGERPSGMFDSSVLCECYDAGCAWYELTPAETSVRLRAYLNTPGLPVCQDHLEFWESVFTGLTHIDAHFLSQTKQAGDNFPYLTAYQATVCARSQAPPPSWDQMWKCLLRLKPTLHGPTPLLYRLGAVQNEITLTHPITKFIMACMSADLEVVTSTWVLVGGVLAALAAYCLTTGSVVIVGRIILSGRPAVIPDREVLYREFDEMEECATHLPYIEQGMQLAEQFKQKALGLLQTASKQAEAAAPVMESKWRALETFWAKHMWNFISGIQYLAGLSTLPGNPAIASLMAFTASVTSPLTTQSTLLFNILGGWVAAQLAPPSAASAFVGAGIVGAAVGSIGLGRVLVDILAGYGAGVAGALVAFKVMSGDMPSTEDLVNLLPAILSPGALVVGVVCAAILRRHVGPGEGAVQWMNRLIAFASRGNHVSPTHYVPESDAAARVTQILSNLTITQLLKRLHQWINEDCSTPCSGSWLRDVWDWICTVLADFKTWLQSKLLPRLPGVPFFSCQRGYKGIWRGDGIMHTTCSCGAQITGHVKNGSMRIVGPRTCSNTWHGTFPINAYTTGSCTPSPAPNYSKALWRVAAEEYVEVTRVGDFHYVTGVTTDNIKCPCQVPAPEFFTELDGVRLHRYAPACKPLLRDEVTFQVGLNQYTVGSQLPCEPEPDVTVVTSMLTDPSHITAEAARRRLARGSPPSLASSSASQLSALSLKATCTTHHGAPDTDLIEANLLWRQEMGGNITRVESENKVVVLDSFEPLRAEEDEREPSVPAEILRKTRKFPAAMPVWARPDYNPPLLESWKNPDYVPPVVHGCPLPPTKTPPIPPPRRKKTVVLTESTVSSALAELAVKAFGSSGSSAADSGTATAPPGQPSDCGDTGSDAESYSSMPPLEGEPGDPDFSDGSWSTVSEEAGEDVVCCSMSYTWTGALITPCAAEESKLPINALSNSLLRHHSMVYSTTSRSASQRQKKVTFDRLQVLDDHYQDVLKEMKAKASTVKARLLSVEEACRLTPPHSARSKFGYGAKDVRNLSGKAVNHIRSVWKDLLEDTDTPIDTTIMAKNEVFCIQPEKGGRKPARLIVYPDLGVRVCEKMALYDVVSTLPQAVMGPSYGFQYSPGQRVEFLVNAWKSKKCPMGFAYDTRCFDSTVTENDIRVEESIYQSCDLAPEARQAIRSLTERLYIGGPLTNSKGQSCGYRRCRASGVLTTSCGNTLTCYLKASAACRAAKLRDCTMLVCGDDLVVICESAGTQEDAANLRVFTEAMTRYSAPPGDPPQPEYDLELITSCSSNVSVARDASGKRVYYLTRDPTTPIARAAWETARHTPVNSWLGNIIMYAPTLWARMILMTHFFSILLAQEQLEKALDCQIYGATYSIEPLDLPQIIQRLHGLSAFSLHSYSPGEINRVAACLRKLGVPPLRVWRHRARSVRAKLLSRGGRAATCGRYLFNWAVKTKLKLTPIPAASQLDLSGWFVAGYSGGDIYHSVSRARPRWFMWCLLLLSVGVGIYLLPNR

SEQ ID NO: 31 - protein, 3011 aa, Artificial Sequence
  Recombinant polypeptide
MSTNPKPQRRTKRNTNRRPQDVKFPGGGQIVGGVYLLPRRGPRLGVRAIRKTSERSQPRGRRQPIPKARRPEGRAWAQPGYPWPLYGNEGLGWAGWLLSPRGSRPSWGPSDPRRRSRNLGKVIDTLTCGFADLMGYIPLVGGPLGGAARALAHGVRVLEDGVNYATGNMPGCSFSIFLLALLSCLTIPASAYEVRNVSGIYHVTNDCSNASIVYEAADMIMHTPGCVPCVRESNFSRCWVALTPTLAARNSSIPTTTIRRHVDLLVGAAALCSAMYVGDLCGSVLLVSQLFTFSPRRHETVQDCNCSIYPGHLSGHRMAWDMMMNWSPTAALVVSQLLRIPQAVVDMVVGAHWGVLAGLAYYSMVGNWAKVLIVMLLFAGVDGHTHVTGGRVASSTQSLVSWLSQGPSQKIQLVNTNGSWHINRTALNCNDSLQTGFIAALFYAHRFNASGCPERMASCRPIDKFAQGWGPITHVVPNISDQRPYCWHYAPQPCGIVPASQVCGPVYCFTPSPVVVGTTDRSGVPTYSWGENETDVLLLNNTRPPQGNWFGCTWMNGTGFTKTCGGPPCNIGGVGNNTLICPTDCFRKHPEATYAKCGSGPWLTPRCIVDYPYRLWHYPCTVNFTVFKVRMYVGGVEHRLNAACNWTRGERCDLEDRDRSELSPLLLSTTEWQILPCAFTTLPALSTGLIHLHRNIVDVQYLYGIGSAVVSFAIKWEYILLLFLLLADARVCSCLWMMLLIAQAEATLENLVVLNAASVAGTHGILSLLVFFCAAWYIKGRLVPGAAYAFYGVWPLLLLLLALPPRAYAMEREMAASCGGGVFVGLVLLTLSPYYKVFLARLIWWLQYLITRAEAHLQVWVPPLNVRGGRDAIILLTCAVHPELIFDITKLLLAILGPLMVLQAGITRVPYFVRAQGLLRACMLVRKVAGGHYVQMAFMKLAALTGTYVYDHLTPLRDWAHVGLRDLAVAVEPVVFSDMETKLITWGADTAACGDIISGLPVSARRGKEILLGPADSFGEQGWRLLAPITAYSQQTRGLLGCIITSLTGRDKNQVDGEVQVLSTATQSFLATCVNGVCWTVYHGAGSKTLAGPKGPITQMYTNVDQDLVGWPAPPGARSMTPCTCGSSDLYLVTRHADVVPVRRRGDSRGSLLSPRPISYLKGSSGGPLLCPSGHVVGIFRAAVCTRGVAKAVDFVPVESLETTMRSPVFTDNSSPPTVPQSYQVAHLHAPTGSGKSTRVPAAYAAQGYKVLVLNPSVAATLSFGAYMSKAHGTDPNIRTGVRTITTGSPITYSTYGKFLADGGCSGGAYDIIICDECHSTDSTTVLGIGTVLDQAETAGVRLTVLATATPPGSVTVPHPNIEEVALSTTGEIPFYGKAIPIEVIKGGRHLIFCHSKKKCDELAAKLSSLGLNAVAYYRGLDVSVIPSSGDVVVVATDALMTGYTGDFDSVIDCNTCVIQTVDFSLDPTFTIETTTVPQDAVSRTQRRGRTGRGRGGIYRFVTPGERPSGMFDSSVLCECYDAGCAWYELTPAVTSVRLRAYLNTPGLPVCQVHLEFWESVFTGLTHIDAHFLSQTKQAGDNFPYLVAYQATVCARAKAPPPSWDQMWKCLIRLKPTLHGSTPLLYRLGAVQNEVTLTHPITKYIMTCMSADLEVATSTWVLVGGVLAALAAYCLTTGSVVIVGRIILSGKPAVIPDREVLYKEFDEMEECASHLPYIEQGVQLAEQFKQKALGLLQTATKQAEAAAPVVESKWQALEAFWAKHMWNFISGIQYLAGLSTLPGNPAIASLMAFTASITSPLTTQNTLLFNILGGWVAAQLAPPSAASAFVGAGIVGAAVGSVGLGKVLVDILAGYGAGVAGALVAFKVMSGEMPSTEDLVNLLPAILSPGALVVGVVCAAVLRRHVGPGEGAVQWMNRLIAFASRGNHVSPTHYVPESDAAARVTQILSGLTITQLLKRLHQWINEDCSTPCSGSWLKDVWDWICTVLSDFKTWLQSKLLPRLPGLPFLSCQRGYKGVWRGDGIMQTTCPCGAQITGHVKNGSMRIVGPKTCSNMWHGTFPINAYTTGPCTPSPAPNYSRALWRVAAEEYVEITRVGDFHYVTGMTTDNLKCPCQVPAPEFFTEVDGVRLHRYAPVCKPLLREEVVFQVGLNQYPVGSQLPCEPEPDVAVLTSMLTDPSHITAETAKRRLARGSPPSLARSSASQLSAPSLKATCTTHHDSPDADLIEANLLWRQAMGGNITRVESENKVVILDSFDPLHAEEDEREVSVAAEILRKSRKFPPALPIWARPDYNPPLLESWKDPDYVPPVVHGCPLPPTKAPPVPPPRRKRTIVLTESTVSSALAELATKTFGSSGSSAVDSGTATAPPDQASDDGDKGSDVESYSSMPPLEGEPGDPDLSDGSWSTVSSDGGTEDVVCCSMSYSWTGALITPCAAEESKLPINPLSNSLLRHHNLVYSTTSRSASLRQKKVTFDRLQVLDDHYRDVLKEMKAKASTVKARLLSIEEACKLTPPHSAKSKFGYGAKDVRNLSSRAVNHIRSVWEDLLEDTETPIDTTIMAKSEVFCVQPEKGGRKPARLIVFPDLGVRVCEKMALYDVVSTLPQAVMGSSYGFQYSPKQRVEFLVNTWKSKKCPMGFSYDTRCFDSTVTENDIRTEESIYQCCDLAPEARQAIRSLTERLYVGGPLTNSKGQNCGYRRCRASGVLTTSCGNTLTCYLKATAACRAAKLQDCTMLVCGDDLVVICDSAGTQEDAASLRVFTEAMTRYSAPPGDLPQPEYDLELITSCSSNVSVAYDASGKRVYYLTRDPSTPLARAAWETVRHTPVNSWLGNIIMYAPTLWARMILMTHFFSILLAQEQLGKALDCQIYGACYSIEPLDLPLIIQRLHGLSAFSLHSYSPGEINRVASCLRKLGVPPLRAWRHRARSVRATLLSQGGRAAICGKYLFNWAVKTKLKLTPIPAASQLDLSNWFVAGYNGGDIYHSLSRARPRWIMWCLLLLSVGVGIYLLPNR

SEQ ID NO: 32 - protein, 3010 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARRPEGRTWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHITGHRMAWDMMMNWSPTTALVVSQLLRIPQAVVDMVAGAHWGVLAGLAYYSMVGNWAKVLIVMLLFAGVDGHTHVTGGRVASSTQSLVSWLSQGPSQKIQLINTNGSWHINRTALNCNDSLQTGFLAALFYTHKFNASGCPERMASCRPIDEFAQGWGPITYAEPGSSDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALSTGLIHLHQNIVDVQYLYGVGSSIASWAIKWEYVVLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLVLLTLSPYYKVFLARLIWWLQYFITRAEAHLQVWVPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGREILLGPADSLEGQGWRLLAPITAYAQQTRGLLGCIITSLTGRDKNQVEGEVQVVSTATQSFLATCINGVCWTVYHGAGSKTLAGPKGPITQMYTNVDQDLVGWQAPPGARSLTPCTCGSSDLYLVTRHADVIPVRRRGDSRGSLLSPRPISYLKGSSGGPLLCPSGHAVGIFRAAVCTRGVAKAVDFIPVESMETTMRSPVFTDNSSPPAVPQTFQVAHLHAPTGSGKSTKVPAAYAAQGYKVLVLNPSVAATLGFGAYMSKAHGVDPNIRTGVRTITTGAPITYSTYGKFLADGGCSGGAYDIIICDECHSTDATSILGIGTVLDQAETAGARLVVLATATPPGSVTVPHPNIEEVALSTTGEIPFYGKAIPIETIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVTSTWVLVGGVLAALAAYCLTTGSVVIVGRIILSGKPAIIPDREVLYREFDEMEECASHLPYIEQGMQLAEQFKQKALGLLQTATKQAEAAAPVVESKWRALEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAETAKRRLARGSPPSLASSSASQLSAPSLKATCTTHHDSPDADLIEANLLWRQEMGGNITRVESENKVVILDSFDPLRAEEDEREVSVPAEILRKSRKFPPALPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKSKKTPMGFSYDTRCFDSTVTESDIRVEESIYQCCDLAPEARQAIRSLTERLYIGGPLTNSKGQNCGYRRCRASGVLTTSCGNTLTCYLKASAACRAAKLQDCTMLVCGDDLVVICESAGTQEDAASLRVFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRAKLLSQGGRAATCGKYLFNWAVRTKLKLTPIPAASQLDLSGWFVAGYSGGDIYHSLSRARPRWFMWCLLLLSVGVGIYLLPNR

SEQ ID NO: 33 - protein, 3011 aa, Artificial Sequence
  Recombinant polypeptide
MSTNPKPQRKTKRNTNRRPQDVKFPGGGKIVGGVYLLPRRGPRLGVRAPRKTSERSQPRGRRQPIPKARRPEGRTWAQPGYPWPLYGNEGCGWAGWLLSPRGSRPSWGPNDPRRRSRNLGKVIDTLTCGLADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAAKDTSGFTSLFRIGARQNIQLINSNGSWHINRTALNCNDSLQTGFLAALFYTHKFNSSGCPERLASCRPLTDFAQGWGPISYANGSGPDQRPYCWHYPPKPCGIVPAKSVCGPVYCFTPSPVVVGTTDRSGAPTYNWGENDTDVFVLNNTRPPLGNWFGCTWMNSSGFTKVCGAPPCVIGGVGNNTLHCPTDCFRKHPEATYSRCGSGPWITPRCLVHYPYRLWHYPCTINYTIFKVRMYVGGVEHRLEAACNWTRGERCNLEDRDRSELSPLLLSTTQWQVLPCSFTTLPALSTGLIHLHQNVVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIVTSLTGRDKNQVEGEVQIVSTAAQTFLATCINGVCWTVYHGAGTRTIASPKGPVIQMYTNVDKDLVGWPAPQGARSLTPCACGSSDLYLVTRHADVIPVRRRGDGRGSLLSPRPVSYLKGSSGGPLLCPSGHAVGIFRAAVCTRGVAKAVDFVPVESMETTMRSPVFTDNSSPPAVPQTFQVAHLHAPTGSGKSTRVPAAYAAQGYKVLVLNPSVAATLSFGAYMSKAHGVDPNIRTGVRTITTGAPITYSTYGKFLADGGCSGGAYDIIMCDECHSTDSTTILGIGTVLDQAETAGARLVVLATATPPGSITVPHPNIEEVALSNTGEIPFYGKAIPIETIKGGRHLIFCHSRKKCDELAAKLSGLGLNAVAYYRGLDVSVIPASGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGSTPLLYRLGAVQNEITLTHPVTKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGVQYLAGLSTLPGNPAIASLMAFTAAVTSPLTTSQTLLFNILGGWVAAQLAAPGAATAFVGAGLAGAAIGSVGLGKVLVDIIAGYGAGVAGALVAFKIMSGEVPSTEDLVNLLPAILSPGALVVGVVCAAVLRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVVLDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSGADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVYPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTIPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 34 - protein, 3010 aa, Artificial Sequence
  Recombinant polypeptide
MSTNPKPQRRTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGRVIDTLTCGFADLMGYIPLVGAPLGGVARALAHGVRVVEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHVSGHRMAWDMMMNWSPTAALVVSQLLRIPQAVVDMVAGAHWGVLAGLAYYSMVGNWAKVLIVMLLFAGVDGHTHVTGGRVASSTQSLVSWLSQGPSQKIQLVNTNGSWHINRTALNCNDSLNTGFLAALFYTHSFNASGCPERMASCRPIDKFDQGWGPITYAEPGSSDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALTTGLIHLHQNIVDVQYLYGIGSAVVSFAIKWEYVLLLFLLLADARVCACLWMMLLIAQAEAALENLVVLNAASVAGAHGILSFLVFFCAAWYIKGRLVPGAAYALYGVWPLLLLLLALPPRAYAMDREMAASCGGAVFVGLALLTLSPHYKVFLARLIWWLQYFITRAEAHLQVWIPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGKEILLGPADSLEGQGWRLLAPITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYTVLVLNPSVAATLGFGAYMSKAHGIDPNIRTGVRTITTGSPITYSTYGKFLADGGCSGGAYDIIICDECHSTDATSILGIGTVLDQAETAGVRLTVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETTTLPQDAVSRTQRRGRTGRGKPGIYRFVAPGERPSGMFDSSILCECYDAGCAWYELTPAETSVRLRAYLNTPGLPVCQDHLEFWESVFTGLTHIDAHFLSQTKQAGDNFPYLVAYQATVCARAQAPPPSWDQMWKCLTRLKPTLHGPTPLLYRLGAVQNEVTLTHPITKYIMACMSADLEVVTSTWVLVGGVLAALAAYCLTTGSVVIVGRIILSGKPAVIPDREVLYQEFDEMEECASHLPYIEQGMQLAEQFKQKALGLLQTATKQAEAAAPVVESKWRALETFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVQESDAAARVTQILSSLTITQLLKRLHQWINEDCSTPCSGSWLRDVWDWICTVLTDFKTWLQSKLLPRLPGVPFFSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVTVLTSMLTDPSHITAETAKRRLARGSPPSLASSSASQLSAPSLKATCTTHHDSPDADLIEANLLWRQEMGGNITRVESENKVVILDSFDPLRAEEDEREVSVPAEILRKSRKFPPALPVWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKSEVFCVQPEKGGRKPARLIVFPDLGVRVCEKMALYDVVSTLPQAVMGSSYGFQYSPKQRVEFLVNAWKSKKCPMGFAYDTRCFDSTVTENDIRVEESIYQCCDLAPEARQAIRSLTERLYIGGPLTNSKGQNCGYRRCRASGVLTTSCGNTLTCYLKASAACRAAKLQDCTMLVNGDDLVVICESAGTQEDAASLRVFTEAMTRYSAPPGDPPKPEYDLELITSCSSNVSVAHDASGKRVYYLTRDPTTPLARAAWETARHTPINSWLGNIIMYAPTLWARMILMTHFFSILLAQEQLEKALDCQIYGACYSIEPLDLPQIIERLHGLSAFSLHSYSPGEINRVASCLRKLGVPPLRVWRHRARSVRAKLLSQGGRAATCGKYLFNWAVKTKLKLTPIPAASQLDLSGWFVAGYSGGDIYHSLSRARPRWFMWCLLLLSVGVGIYLLPNR

SEQ ID NO: 35 - protein, 3011 aa, Artificial Sequence
  Recombinant polypeptide
MSTNPKPQRQTKRNTNRRPQDVKFPGGGQIVGGVYLLPRRGPRLGVRAPRKTSERSQPRGRRQPIPKARRPEGRTWAQPGYPWPLYGNEGMGWAGWLLSPRGSRPSWGPSDPRRRSRNLGKVIDTLTCGFADLMGYIPLVGAPLGGAARVLAHGVRALEDGVNYATGNLPGCSFSIFLLALLSCLTIPASAYEVRNASGVYHVTNDCSNSSIVYETADSILHSPGCVPCVREGNSSRCWVALTPTLAARNSSIPTTTIRRHVDLLVGAAALCSAMYVGDLCGSVFLVSQLFTFSPRRYETVQDCNCSIYPGHVSGHRMAWDMIMNWSPTTALVVSQLLRIPQAVVDMVAGAHWGVLAGLAYYSMAGNWAKVLIVMLLFAGVDGHTHVTGGRVASSTQSLVSWLSQGPSQKIQLVNTNGSWHINRTALNCNDSLQTGFIAALFYTHRFNSSGCPERMASCRSIDKFDQGWGPITYAEPSNSDQRPYCWHYAPQPCGIVPASEVCGPVYCFTPSPVVVGTTDRFGVPTYSWGENETDVLLLNNTRPPQGNWFGCTWMNSTGFTKTCGGPPCNIGGAGNNTLICPTDCFRKHPEATYTRCGSGPWLTPRCMVDYPYRLWHYPCTVNFTVFKVRMYVGGVEHRLNAACNWTRGERCDLEDRDRSELSPLLLSTTEWQILPCSFTTLPALTTGLIHLHQNIVDVQYLYGVGSSIASWAIKWEYVILLFLLLADARICSCLWMMLLISQAEAALENLVLLNAASLAGTHGLVSFLVFFCAAWYIKGRLVPGAAYALYGVWPLLLLLLTLPPRAYAMDREMAASCGGAVFVGLVLLTLSPHYKVFLARLIWWLQYFITRAEAHLQVWIPPLNVRGGRDAIILLTCAIHPELIFTITKILLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIISGLPVSARRGKEILLGPADSFGEQGWRLLAPITAYSQQTRGLFGCIITSLTGRDKNQVDGEVQVLSTATQSFLATCVNGVCWTVYHGAGSKTLAGPKGPITQMYTNVDQDLVGWPAPPGARSMTPCTCGSSDLYLVTRHADVIPVRRRGDGRGSLLSPRPVSYLKGSSGGPLLCPSGHVVGIFRAAVCTRGVAKAVDFIPVESLETTMRSPVFTDNSSPPAVPQSFQVAHLHAPTGSGKSTKVPAAYATQGYKVLVLNPSVAATLGFGAYMSKAHGIEPNIRTGVRTITTGASITYSTYGKFLADGGCSGGAYDIIICDECHSTDSTTILGIGTVLDQAETAGARLVVLATATPPGSITVPHPNIEEVALSNTGEIPFYGKAIPLEAIKGGRHLIFCHSRKKCDELAAKLVALGVNAVAYYRGLDVSVIPTSGDVVVVATDALMTGFTGDFDSVIDCNTCVTQTVDFSLDPTFTIETTTLPQDAVSRSQRRGRTGRGRGGIYRFVTPGERPSGMFDSSVLCESYDAGCAWYELTPAETTVRLRAYLNTPGLPVCQDHLEFWESVFTGLTHIDAHFLSQTKQSGENFPYLVAYQATVCARAQALPPSWDQMWKCLVRLKPTLHGATPLLYRLGAVQNEVTLTHPVTKYIMTCMSADLEVVTSTWVLVGGVLAALAAYCLTTGCVVIVGRVVLSGKPAVVPDREVLYQEFDEMEECASHLPYIEQGMQLAEQFKQKALGLLQIATKQAEAAAPVVESKWRALETFWAKHMWNFISGIQYLAGLSTLPGNPAIASLMAFTAAVTSPLTTSQTLLFNILGGWVAAQLAAPGAATAFVGAGLAGAAIGSVGLGKVLVDIIAGYGAGVAGALVAFKIMSGEVPSTEDLVNLLPAILSPGALVVGVVCAAILRRHVGPGEGAVQWMNRLIAFASRGNHVSPTHYVPESDAAARVTQILSNLTITQLLKRLHQWINEDCSTPCSGSWLKDVWDWICTVLSDFKTWLQSKLLPRLPGVPFFSCQRGYKGVWRGDGIMQTTCPCGAQIAGHVKNGSMRIVGPRTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVTVVTSMLTDPSHITAEAARRRLARGSPPSLASSSASQLSAPSLKATCTTRHDSPDADLIEANLLWRQAMGGNITRVESENKVVILDSFEPLRAEEDEREVSVAAEILRKSKKFPPALPIWARPDYNPPLLESWKDPDYVPPVVHGCPLPPAKAPPIPPPRRKRTVVLTESTVSSALAELATKTFGSSESSAVDSGTATAPPDQPSDDGDAGSDVESYSSMPPLEGEPGDPDLSDGSWSTVSSEAGTEDVVCCSMSYTWTGALITPCAAEESKLPINPLSNSLLRHHSMVYSTTSRSASLRQKKVTFDRLQVLDDHYRDVLKEMKAKASTVKAKLLSIEEACKLTPPHSAKSKFGYGAKDVRSLSSRAVNHIRSVWEDLLEDTETPIDTTIMAKSEVFCVQPEKGGRKPARFIVFPDLGVRVCEKMALYDVVSTLPQAVMGPSYGFQYSPKQRVEFLVNTWKSKKCPMGFSYDTRCFDSTVTESDIRVEESIYQCCDLAPEARQAIKSLTERLYIGGPLTNSKGQNCGYRRCRASGVLTTSCGNTLTCYLKATAACRAAKLQDCTMLVNGDDLVVICESQGVQEDAANLRVFTEAMTRYSAPPGDLPQPEYDLELITSCSSNVSVAHDASGKRVYYLTRDPTTPLARAAWETVRHTPVNSWLGNIIMYAPTLWARMVLMTHFFSILIAQEQLEKALDCQIYGACYSIEPLDLPQIIERLHGLSAFTLHSYSPGEINRVAACLRKLGVPPLRAWRHRARSVRARLLSQGGRAAICGKYLFNWAVKTKLKLTPIPAASQLDLSGWFVAGYSGGDIYHSLSRARPRWFMLCLLLLSVGVGVYLLPNR

SEQ ID NO: 36 - protein, 3010 aa, Artificial Sequence
  Recombinant polypeptide
MSTNPKPQRKTKRNTNRRPQDVKFPGGGQIVGGVYLLPRRGPRLGVRATRKTSERPQPRGRRQPIPKARQPEGRAWAQPGYPWPLYGNEGLGWAGWLLSPRGSRPSWGPTDPRRRSRNLGRVIDTLTCGFADLMGYIPLVGAPLGGVARALAHGVRVLEDSVNYATGNLPGCPFSIFLLALLSCLTTPASAYEVRNVSGVYHVTNDCSNASIVYEAADMIMHTPGCVPCVRENNSSRCWVALTPTLAARNASVPTTTIRRHVDLLVGAAAFCSAMYVGDLCGSVFLISQLFTFSPRRHETVQDCNCSIYPGHVTGHRMAWDMMMNWSPTAALVVSQLLRIPQAVMDMVAGAHWGILAGLAYYSMVGNWAKVLIVLLLFAGVDGNTRVSGGEAAKNTMGFASLFVSGPSQKIQLINTNGSWHINSTALNCNDSLNTGFLAALFYTHRFNASGCPERMASCRPIDEFAQGWGPITYTEPHDLDQRPYCWHYAPRPCGIVPASQVCGPVYCFTPSPVVVGTTDRSGAPTYNWGENDTDVFVLNNTRPPLGNWFGCTWMNSSGFTKVCGAPPCVIGGVGNNTLHCPTDCFRKHPEATYSRCGSGPWITPRCLVHYPYRLWHYPCTINYTIFKVRMYVGGVEHRLDAACNWTRGERCNLDDRDRSELSPLLLSTTQWQVLPCSFATLPALSTGLIHLHQNVVDVQYLYGVGSSIVSWAIKWEYVVLLFLLLADARVCSCLWMMLLISQVEAALENLVILNAASLAGTHGLASFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGQEILLGPADGMVSKGWRLLAPITAYAQQTRGLLGCIVTSLTGRDKNQVEGEVQIVSTAAQTFLATCINGVCWTVYHGAGTRTIASPKGPVIQMYTNVDKDLVGWPAPQGARSLTPCACGSSDLYLVTRHADVIPVRRRGDSRGSLLSPRPISYLKGSSGGPLLCPAGHAVGIFRAAVCTRGVAKAVDFIPVENLETTMRSPVFTDNSTPPAVPQSYQVAHLHAPTGSGKSTKVPAAYAAQGYKVLVLNPSVAATLGFGVYMSKAHGIDPNIRTGVRTITTGSPITYSTYGKFLADGGCSGGAYDIIICDECHSTDATSILGIGTVLDQAETAGVRLTVLATATPPGSVTVPHSNIEEVALSTTGEIPFYGKAIPLEVIKGGRHLIFCHSKKKCDEVAAKLVALGINAVAYYRGLDVSVIPASGDVVVVATDALMTGFTGDFDSVIDCNTCVTQTVDFSLDPTFTIETITLPQDAVSRTQRRGRTGRGKPGIYRFVAPGERPSGMFDSSILCECYDAGCAWYELTPAETTVRLRAYMNTPGLPVCQDHLEFWEGVFTGLTHIDAHFLSQTKQSGENLPYLVAYQATVCARARAPPPSWDQMWKCLIRLKPTLHGATPLLYRLGAVQNEITLTHPITKYIMACMSADLEVATSTWVLVGGVLAALAAYCLTTGSVVIVGRIILSGKPAVIPDREVLYQEFDEMEECATHLPYIEQGMQLAEQFRQKALGLLQTATKQAEAAVPVVESKWRALEAFWAKHMWNFISGIQYLAGLSTLPGNPAIVSLMAFTASVTSPLTTQHTLLFNILGGWVAAQLAPPSAASAFVGAGIVGAAVGSVGLGKVLVDILAGYGAGVAGALVAFKVMSGDMPSTEDLVNLLPAILSPGALVVGVVCAAVLRRHVGPGEGAVQWMNRLIAFASRGNHVSPTHYVPESDAAARVTQILSSLTITQLLKRLHRWINEDCSTPCSGSWLRDVWDWICTVLTDFKTWLQSKLMPRLPGVPFLSCQRGYKGIWRGDGIMHTTCPCGAQITGHVKNGSMRIVGPKTCSNTWHGTFPINAYTTGPCTPLPAPNYKFALWRVSAEEYVEIRRVGDFHYVTGMTTDNIKCPCQVPAPEFFTELDGVRLHRYAPACKPLLRDEVTFQVGLNQYVVGSQLPCEPEPDVTVLTSMLTDPSHITAETAKRRLARGSPPSMASSSASQLSAPSLKATCTTHHDSPDADLIEANLLWRQEMGGNITRVESENKVVVLDSFDPLRAEEDEREVSVPAEILRKSRKFPRAMPIWARPDYNPPLIESWKDPDYAPPVVHGCPLPPTKAPPIPPPRRKRTVVLSESTVSSALAELATKTFGSSGSSAVDSGTATAPPDQASDDGDKGSDVESYSSMPPLEGEPGDPDLNDGSWSTVSEEASEDVVCCSMSYSWTGALITPCVAEESKLPINALSNSLLRHHNMVYATTSRSASQRQKKVTFDRLQVLDNHYQDVLKEMKAKASTVKAKLLSVEEACKLTPPHSARSKFGYGAKDVRNLSSKAVNHIRSVWKDLLEDTETPIDTTVMAKNEVFCVQPEKGGRKPARLIVYPDLGVRVCEKMALYDVVSTLPQAVMGSSYGFQYSPGQRVEFLVNAWKSKKNPMGFAYDTRCFDSTVTENDIRVEESIYQSCDLAPEARQAIRSLTERLYIGGPLTNSKGQSCGYRRCRASGVLTTSCGNTLTCYLKASAACRAAKLRDCTMLVCGDDLVVICESAGTQEDAASLRVFTEAMTRYSAPPGDPPKPEYDLELITSCSSNVSVAHDATGKRVYYLTRDPATPFARAAWETARHTPVNSWLGNIIMFAPTLWVRMILMTHFFSILLAQEQLEKALDCQIYGATYSIEPLDLPQIIQRLHGLSAFSLHSYSPGEINRVASCLRKLGVPPLRVWRHRARSVRAKLLSQGGRAATCGKYLFNWAVRTKLKLTPIPAASRLDLSGWFVAGYGGGDIYHSVSRARPRWFMWCLLLLSVGVGIYLLPNR

SEQ ID NO: 37 - protein, 3011 aa, Artificial Sequence
  Recombinant polypeptide
MSTNPKPQRRTKRNTNRRPQDVKFPGGGQIVGGVYLLPRRGPKLGVRATRKTSERSQPRGRRQPIPKARRPEGRAWAQPGYPWPLYGNEGCGWAGWLLSPRGSRPSWGPNDPRRRSRNLGKVIDTLTCGLADLMGYIPLVGAPLGGAARALAHGVRVLEDGVNYATGNIPGCSFSIFLLALLSCLTVPASAYQVRNSTGLYHVTNDCPNSSIVYEAADAILHTPGCVPCVREGNASRCWVAMTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAGTHVTGGSAAKDTSGFTSLFRIGARQNIQLINTNGSWHINRTALNCNASLDTGWVAGLFYYHKFNSSGCPERLASCRPLADFDQGWGPISYANGSGPEHRPYCWHYPPKPCGIVPAKSVCGPVYCFTPSPVVVGTTDRFGAPTYNWGENETDVLILNNTRPPQGNWFGCTWMNGTGFTKTCGAPPCNIGGVGNNTLTCPTDCFRKHPEATYTKCGSGPWLTPRCLVDYPYRLWHYPCTVNFTIFKVRMYVGGVEHRLEAACNWTRGERCNLEDRDRSELSPLLLSTTEWQVLPCSFTTLPALSTGLIHLHRNIVDVQYLYGIGSAVVSFAIKWEYVLLLFLLLADARVCACLWMMLLIAQAEAALENLVVLNAASVAGAHGILSFLVFFCAAWYIKGKLVPGAAYAFYGVWPLLLLLLALPPRAYAMDREVAASCGGAVFIGLALLTLSPHYKAFLAKLIWWLQYLITRAEAHLQVWVPPLNVRGGRDAIILLTCAVHPELIFDITKLLLAILGPLMVLQAGLTRVPYFVRAQGLIRMCMLVRKAAGGHYVQMALMKLAALTGTYVYDHLTPLQDWAHAGLRDLAVAVEPVIFSDMETKVITWGADTAACGDIILGLPVSARRGREILLGPADSLEGQGWRLLAPITAYSQQTRGLLGCIITSLTGRDRNQVEGEVQVVSTATQSFLATCINGVCWTVFHGAGSKTLAGPKGPVTQMYTNVDQDLVGWQAPPGARSLTPCTCGSSDLYLVTRHADVIPVRRRGDNRGSLLSPRPISYLKGSSGGPLLCPSGHAVGIFRAAVCTRGVAKAVDFVPVESMETTMRSPVYTDNSSPPAVPQTFQVAHLHAPTGSGKSTRVPAAYAAQGYKVLVLNPSVAATLSFGAYMSKAHGVDPNIRTGVRTITTGAPITYSTYGKFLADGGCSGGAYDIIMCDECHSTDSTSILGIGTVLDQAETAGARLTVLATATPPGSVTVPHPNIEEVALSNIGEIPFYGKAIPIETIKGGRHLIFCHSKKKCDELAAKLSGLGLNAVAYYRGLDVSVIPTSGNVVVVATDALMTGYTGDFDSVIDCNTCVTQSVDFSLDPTFTIETTTVPQDAVSRSQRRGRTGRGRRGIYRFVTPGERPSGMFDSSVLCECYDAGCAWYELTPAETSVRLRAYLNTPGLPVCQVHLEFWESVFTGLTHIDAHFLSQTKQAGDNFPYLVAYQATVCARAQAPPPSWDQMWKCLTRLKPTLHGPTPLLYRLGPVQNEVTLTHPITKFIMACMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGVQYLAGLSTLPGNPPIASLMAFTASITSPLTTQSTLLFNILGGWLAAQLAPPSAASAFVGAGIAGAAVGSIGLGKVLVDVLAGYGAGVAGALVAFKVMSGEMPSTEDLVNLLPAILSPGALVVGVVCAAILRRHVGPGEGAVQWMNRLIAFASRGNHVSPTHYVQESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPSTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGSNITRVESENKVVILDSFDPLVAEEDEREISVPAEILRKSRRFAQALPVWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDFSDGSWSTVSSGADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSARSKYGYGAKDVRCHARKAVNHINSVWKDLLEDSVTPIDTTIMAKNEVFCIQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPINSWLGNIIMFAPTLWARMILMTHFFSVLIARDQLEQALDCEIYGACYSIEPLDLPPIIQRLHGLSAFSLHSYSPGEINRVASCLRKLGVPPLRAWRHRARNVRARLLSRGGRAAICGRYLFNWAVRTKLKLTPIAAAGQLDLSGWFTAGYSGGDIYHSVSHARPRWFWFCLLLLAAGVGIYLLPNR

SEQ ID NO: 38 - protein, 3010 aa, Artificial Sequence
  Recombinant polypeptide
MSTNPKPQRRTKRNTNRRPQDVKFPGGGQIVGGVYLLPRRGPKLGVRATRKTSERSQPRGRRQPIPKARRPEGRAWAQPGYPWPLYGNEGLGWAGWLLSPRGSRPSWGPNDPRRRSRNLGKVIDTLTCGFADLMGYIPFVGAPLGGAARALAHGVRALEDGVNYATGNLPGCSFSIFLLALLSCLTVPASAYQVRNSTGLYHVTNDCPNSSIVYEAADAILHTPGCVPCVRENNSSRCWVALTPTLAARNASVPTTTIRRHVDLLVGTAAFCSAMYVGDLCGSVLLVSQLFTFSPRRHETVQDCNCSIYPGHVTGHRMAWDMMMNWSPTTALVVSQLLRIPQAVMDMVAGAHWGVLAGLAYYSMAGNWAKVLIVMLLFAGVDGGTYVTGGTMAKNTLGITSLFSPGSSQKIQLVNTNGSWHINRTALNCNDSLNTGFLAALFYTHKFNASGCPERMASCRSIDKFDQGWGPITYAEPHDLDQRPYCWHYAPRPCGIVPASEVCGPVYCFTPSPVVVGTTDRFGVPTYSWGENETDVLLLNNTRPPQGNWFGCTWMNGTGFTKTCGGPPCNIGGVGNNTLICPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEAALENLVVLNAASVAGAHGILSFLVFFCAAWYIKGKLVPGAAYAFYGVWPLLLLLMALPARAYAMDREMAASCGGAVFVGLVLLTLSPYYKVFLAKLIWWLQYLITRAEAHLQVWIPPLNVRGGRDAIILLTCAIHPELIFTITKILLAILGPLMVLQAGITKVPYFVRAHGLIRACMLVRKAAGGHYVQMALMKLAALTGTYVYDHLTPLRDWAHAGLRDLAVAVEPVVFSDMETKVITWGADTAACGDIILGLPVSARRGKEIFLGPADSLEGQGWRLLAPITAYSQQTRGLLGCIITSLTGRDRNQVEGEVQVVSTATQSFLATCINGVCWTVFHGAGSKTLAGPKGPVTQMYTNVDQDLVGWQAPPGARSLTPCTCGSSDLYLVTRHADVIPVRRRGDNRGSLLSPRPISYLKGSSGGPLLCPSGHAVGIFRAAVCTRGVAKAVDFVPVESMETTMRSPVFTDNSSPPAVPQTFQVAHLHAPTGSGKSTKVPAAYASQGYKVLVLNPSVAATLSFGAYMSKAHGVDPNIRTGIRTITTGAPITYSTYGKFLADGGCSGGAYDIIICDECHSTDSTTILGIGTVLDQAETAGVRLTVLATATPPGSVTVPHPNIEEVALSNIGEIPFYGKAIPIETIKGGRHLIFCHSRKKCDELAAKLSGLGLNAVAYYRGLDVSVIPTSGNVVVVATDALMTGFTGDFDSVIDCNTCVTQTVDFSLDPTFTIDTTTVPQDAVSRTQRRGRTGRGRRGIYRFVTPGERPSGMFDSSVLCECYDAGCAWYELTPSETTVRLRAYMNTPGLPVCQDHLEFWEGVFTGLTHIDAHFLSQTKQAGDNFPYLVAYQATVCARSQAPPPSWDQMWKCLLRLKPTLHGATPLLYRLGAVQNEVTLTHPVTKYIMTCMSADLEVVTSTWVLVGGVLAALAAYCLSTGCVVIVGRVVLSGKPAIVPDREVLYQEFDEMEECSQHLPYIEQGMALAEQFKQKALGLLQTASRQAEVITPAVQTNWQKLEVFWAKHMWNFISGIQYLAGLSTLPGNPPIASLMAFTASITSPLTTQNTLLFNILGGWVAAQLAAPGAATAFVGAGLAGAAVGSVGLGKVLVDIIAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRGDGVMHTRCHCGAEITGHVKNGTMRIVGPRTCRNMWSGTFPINAYTTGPCTPLPAPNYKFALWRVSAEEYVEIRQVGDFHYVTGMTTDNLKCPCQIPSPEFFTELDGVRLHRYAPPCKPLLREEVSFRVGLHDYPVGSQLPCEPEPDVTVVTSMLTDPSHITAEAAGRRLARGSPPSVASSSASQLSAPSLKATCTTNHDSPDAELIEASLLWRQEMGGNITRVESENKIVILDSFEPLRAEEDEREVSVAAEILRKTRKFPAAMPVWARPDYNPPLIESWKDPDYVPPVVHGCPLPPTKAPPIPPPRRKRTVVLTESTVSSALAELATKTFGSSGSSAVDSGTATGPPDQASAEGDAGSDAESYSSMPPLEGEPGDPDFSDGSWSTVSEEASEDVVCCSMSYTWTGALITPCAAEETKLPINALSNSLLRHHNLVYATTSRSASLRQKKVTFDRMQVLDDHYRDVLKEMKAKASTVKAKLLSVEEACKLTPPHSARSKFGYGAKDVRNLSSKAVNHIHSVWKDLLEDTETPIDTTIMAKNEVFCIQPEKGGRKPARLIVYPDLGVRVCEKMALYDVVSTLPQAVMGSSYGFQYSPKQRVEFLVNAWKSKKCPMGFAYDTRCFDSTVTENDIRVEESIYQCCDLAPEARQVIRSLTERLYIGGPLTNSKGENCGYRRCRASGVLTTSCGNTLTCYIKAQAACRAAGLRDCTMLVCGDDLVVICESAGTQEDAANLRVFTEAMTRYSAPPGDLPQPEYDLELITSCSSNVSVAHDASGKRVYYLTRDPTTPLARAAWETVRHTPVNSWLGNIIMFAPTLWARMILMTHFFSVLIARDQLEQALDCEIYGACYSIEPLDLPPIIQRLHGLSAFSLHSYSPGEINRVATCLRKLGVPPLRAWRHRARNVRARLLSRGGRAAICGKYLFNWAVRTKLKLTPIAAAGRLDLSGWFTAGYSGGDIYHSVSHARPRWFWFCLLLLAAGVGIYLLPNR

SEQ ID NO: 39 - protein, 3011 aa, Artificial Sequence
  Recombinant polypeptide
MSTNPKPQRKIKRNTNRRPQDVKFPGGGQIVGGVYLLPRRGPRVGVRATRKTSERSQPRGRRQPIPKARRPEGRSWAQPGYPWPLYGNEGCGWAGWLLSPRGSRPSWGPSDPRRRSRNLGKVIDTLTCGLADLMGYIPLVGAPLGGAARVLAHGVRVLEDGVNYATGNLPGCPFSIFLLALLSCLTIPASAYQVRNSSGLYHVTNDCPNSSIVYETADTILHSPGCVPCVREGNASRCWVAMTPTVATRDGKLPTTQLRRHIDLLVGSATLCSALYVGDLCGSVFLVGQLFTFSPRRHWTTQGCNCSIYPGHITGHRMAWDMMMNWSPTAALVMAQLLRIPQAILDMIAGAHWGVLAGMAYFSMVGNWAKVLVVLLLFAGVDAETHVTGGSAAKDTSGFTSLFRIGARQNIQLINSNGSWHINRTALNCNASLDTGWVAGLFYYHKFNSSGCPERMASCRPLADFDQGWGPISYANGSGPEHRPYCWHYPPKPCGIVPAQNVCGPVYCFTPSPVVVGTTDKSGAPTYNWGANDTDVFVLNNTRPPLGNWFGCTWMNSSGFTKVCGAPPCVIGGVGNNTLHCPTDCFRKHPDATYSRCGSGPWITPRCLVNYPYRLWHYPCTVNYTLFKVRMYVGGVEHRLEVACNWTRGERCDLDDRDRSELSPLLLSTTQWQILPCSFTTLPALTTGLIHLHQNTVDVQYLYGVGSSIVSWAIKWEYVILLFLLLADARICSCLWMMLLISQAEAALENLVLLNAASLAGTHGLASFLVFFCFAWYLKGKWVPGAAYAFYGMWPLLLLLLALPQRAYALDTEMAASCGGVVLVGLVALTLSPYYKRYISWCLWWLQYFLTRVEAHLHVWVPPLNARGGRDAVILLMCVVHPALVFDITKLLLAVFGPLWILQTSLLKVPYFVRVQGLLRLCALARKMAGGHYVQMVIIKLGALTGTYIYNHLTPLRDWAHNGLRDLAVAVEPVVFSQMETKLITWGADTAACGDIINNLPVSARRGQEILLGPADGMVSKGWRLLAPITAYSQQTRGLLGCIVTSLTGRDKNQVEGEVQIVSTAAQTFLATCINGVCWTVYHGAGTRTIASSKGPVIQMYTNVDQDLVGWPAPQGARSLTPCACGSSDLYLVTRHADVIPVRRRGDGRGSLLSPRPISYLKGSSGGPLLCPAGHAVGIFRAAVCTRGVAKAVDFIPVESLETTMRSPVFTDNSTPPAVPQSYQVAHLHAPTGSGKSTRVPAAYAAQGYKVLVLNPSVAATLGFGVYMSKAHGIDPNIRTGVRTITTGAPVTYSTYGKFLADGGCSGGAYDIIMCDECHSTDATSILGIGTALDQAETAGARLTVLATATPPGSVTVSHPNIEEVALSTTGEIPFYGKAIPLEVIKGGRHLIFCHSKRKCDELAAKLVALGINAVAYYRGLDVSVIPTSGDVVVVSTDALMTGFTGDFDSVIDCNTCVIQTVDFSLDPTFTIETITLPQDAVSRTQRRGRTGRGKPGIYRFVAPGERPSGMFDSVVLCECYDAGCAWYELTPAETSVRLRAYLNTPGLPVCQDHLEFWEGVFTGLTRIDAHFLSQTKQSGENFPYLVAYQATVCARAQAPPPSWDQMWKCLTRLKPTLHGPTPLLYRLGAVQNEITLTHPITKYIMTCMAADLEVVTSTWVLVGGVLAALTAYCLSTGCVVIVGRIVLSGKPAIIPDREVLYKEFDEMEECASHLPYIEQGMMLAEQFKQKALGLLQTASRQAEVIAPAVQTNWQKLEAFWAKHMWNFISGVQYLAGLSTLPGNPAIASLMAFTAAVTSPLTTSQTLLFNILGGWLAAQLAAPGAATTFVGAGLAGAAIGSVGLGKVLVDILAGYGAGVAGALVAFKIMSGEAPSTEDLINLLPAILSPGALVVGIVCAAILRRHVGPGEGAVQWMNRLIAFASRGNHVSPTHYVPESDAAARVTTILSSLTVTQLLRRLHQWISSDCTTPCSGSWLRDVWDWICEVLSDFKTWLKAKLVPQLPGIPFVSCQRGYRGVWRGDGIMHTRCHCGAEIAGHVKNGTMRIVGPKTCRNMWSGTFPINAYTTGPCTPLPAPNYTFALWRVSAEEYVEIRRVGDFHYVTGMTADNLKCPCQVPSPEFFTEVDGVRLHRYAPACKPLLREEVTFQVGLNQYLVGSQLPCEPELDVTVLTSMLTDPSHITAEAAKRRLARGSPPSEASSSASQLSAPSLKATCTTHHDSPDADLIEANLLWRQEMGGNITRVESENKVVILDSFEPLQAEEDEREVSVAAEILRKSRKFPPALPIWARPDYNPPLLESWKDPDYVPPVVHGCPLPPPRSPPVPPPRKKRTVVLTESTVSTALAELATKTFGSSGSSAADSGTATAPPDQASDDGDKGSDVESYSSMPPLEGEPGDPDLSDGSWSTVSSEAGTEDVVCCSMSYTWTGALITPCVAEESKLPINPLSNSLLRHHNMIYATTSRSAGLRQKKVTFDRLQVLDDHYRDVLMEVKAKASTVKAKLLSIEEACKLTPPHSAKSKFGYGAKDVRSLSSRAVNHIRSVWEDLLEDTETPIDTTIMAKSEVFCVQPEKGGRKPARFIVFPDLGVRVCEKMALYDVVSTLPQAVMGPSYGFQYSPGQRVEFLVNTWKSKKCPMGFSYDTRCFDSTVTENDIRTEESIYQCCDLAPEARQAIRSLTERLYVGGPLTNSKGQNCGYRRCRASGVLTTSCGNTLTCYLKATAACRAAKLQDCTMLVNGDDLVVICESQGVQEDAANLRAFTEAMTRYSAPPGDPPQPEYDLELITSCSSNVSVAHDGAGKRVYYLTRDPETPLARAAWETARHTPINSWLGNIIMFAPTLWVRMILMTHFFSILLAQEQLEKALGCQIYGATYFIEPLDLPQIIERLHGLSAFTLHSYSPGEINRVASCLRKLGVPPLRAWRHRARSVRAKLLSRGGRAATCGKYLFNWAVKTKLKLTPIAAAGQLDLSGWFTAGYGGGDIYHSVSRARPRWFWFCLLLLTAGVGIYLLPNR

SEQ ID NO: 40 - protein, 3011 aa, Artificial Sequence
  Recombinant polypeptide
MSTNPKPQRKTKRNTNRRPQDVKFPGGGQIVGGVYLLPRRGPRLGVRAPRKTSERSQPRGRRQPIPKARRPEGRTWAQPGYPWPLYGNEGMGWAGWLLSPRGSRPNWGPTDPRRRSRNLGKVIDTLTCGFADLMGYIPLVGGPLGGAARALAHGVRVLEDSVNYATGNLPGCSFSIFLLALLSCLTTPASAYEVRNVSGIYHVTNDCSNASIVYEAADLIMHTPGCVPCVRESNFSRCWVALTPTLAARNSSIPTTTIRRHVDLLVGAAALCSAMYVGDLCGSVFLVSQLFTFSPRRHWTTQDCNCSIYPGHVSGHRMAWDMMMNWSPTTALVVAQLLRIPQAIMDMIAGAHWGVLAGIAYFSMVGNWAKVMVVLLLFAGVDGHTHVTGGRVASSTQSLVSWLSQGPSQKIQLVNTNGSWHINRTALNCNDSLQTGFLAALFYTHRFNASGCPERMASCRPIDKFAQGWGPITHVVPNISDQRPYCWHYAPQPCGIVPASQVCGPVYCFTPSPVVVGTTDRFGAPTYNWGENETDVLILNNTRPPQGNWFGCTWMNSTGFTKTCGGPPCNIGGAGNNTLTCPTDCFRKHPEATYTRCGSGPWLTPRCLVDYPYRLWHYPCTVNFTVFKVRMYVGGVEHRLNAACNWTRGERCDLEDRDRSELSPLLLSTTEWQILPCSFTTLPALSTGLIHLHRNIVDVQYLYGVGSAVVSFAIKWEYILLLFLLLADARICACLWMMLLVAQAEAALENLVVLNAASVAGTHGILSLLVFFCAAWYIKGRLVPGAAYALYGVWPLLLLLLALPPRAYAMDREMAASCGGAVFIGLALLTLSPHYKVFLARLIWWLQYFITRAEAHLQVWVPPLNVRGGRDAIILLTCAVHPELIFDITKLLLAILGPLMVLQAGITRVPYFVRAQGLIRACMLVRKVAGGHYVQMAFMKLAALTGTYVYDHLTPLQDWAHTGLRDLAVAVEPVIFSDMETKIITWGADTAACGDIISGLPVSARRGKEILLGPADSFGEQGWRLLAPITAYSQQTRGLFGCIITSLTGRDKNQVDGEVQVLSTATQSFLATCVNGVCWTVYHGAGSKTLAGPKGPITQMYTNVDQDLVGWPAPPGARSMTPCTCGSSDLYLVTRHADVIPVRRRGDTRGSLLSPRPVSYLKGSSGGPLLCPSGHVVGIFRAAVCTRGVAKAVDFIPVESMETTMRSPIFTDNSSPPAVPQCYQVAHLHAPTGSGKSTKVPAAYAAQGYKVLVLNPSVAATLGFGAYMSKAYGVDPNIRTGVRTITTGASITYSTYGKFLADGGCSGGAYDIIMCDECHSTDSTSILGIGTVLDQAETAGARLVVLATATPPGSITVPHPNIEEVALSNTGEIPFYGKAIPLEAIKGGRHLIFCHSKKKCDELAAKLVALGVNAVAYYRGLDVSIIPTSGDVVVVATDALMTGYTGDFDSVIDCNTCVTQSVDFSLDPTFTIETTTLPQDAVSRAQRRGRTGRGRMGIYRFVTPGERPSGMFDSSILCECYDAGCAWYELTPAETTVRLRAYLNTPGLPVCQVHLEFWESVFTGLTHIDAHFLSQTKQAGENFPYLTAYQATVCARALAPPPSWDQMWKCLIRLKPTLHGPTPLLYRLGAVQNEVILTHPITKYIMACMSADLEIVTSTWVLVGGVLAALAAYCLTTGCVVIVGRIILSGRPAVIPDREVLYREFDEMEECASHLPYIEQGMQLAEQFKQKALGLLQTATKQAEAAAPAVESKWRALETFWAKHMWNFISGIQYLAGLSTLPGNPAIASLMAFTASVTSPLTTQSTLLFNILGGWVAAQLAPPSAASAFVGAGIAGAAIGSIGLGKVLVDILAGYGAGVAGALVAFKVMSGEMPSTEDLVNLLPAILSPGALVVGVVCAAVLRRHVGPGEGAVQWMNRLIAFASRGNHVSPTHYVPESDAAARVTQILSSLTITQLLKRLHRWINEDCSTPCSGSWLKDVWDWICTVLSDFKTWLQSKLLPRLPGVPFFSCQRGYKGVWRGDGIMQTTCPCGAQITGHVKNGSMRIVGPRTCSNTWHGTFPINAHTTGPCTPSPAPNYSRALWRVAAEEYVEVTRVGDFHYVTGMTTDNVKCPCQVPAPEFFTELDGVRLHRFAPPCKPLLRDEVSFRVGLHEYPVGSQLPCEPEPDVAVLTSMLTDPSHITAEAARRRLARGSPPSMASSSASQLSAPSLKATCTANHDSPDAELIEANLLWRQEMGSNITRVESENKVVVLDSFDPLVAEEDEREISVPAEILRKSRRFAQALPVWARPDYNPPLLETWKKPDYEPPVVHGCPLPPPQSPPVPPPRKKRTVVLTESTLSTALAELATKSFGSSSTSGITGDNTTTSSEPAPSGCPPDSDAESCSSMPPLEGEPGDPDLSDGSWSTVSSGADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEIFCVQPEKGGRKAARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRVSGVLTTSCGNTLTCYIKARAACRAAGLQDCTMLVCGDDLVVICESAGVQEDAASLRAFTEAMTRYSAPPGDPPKPEYDLELITSCSSNVSVAHDDAGKRVYYLTRDPAIPLARAAWETVRHTPVNSWLGNIIMYAPTLWARMVLMTHFFSILIAQEQLEKALDCQIYGACYSIEPLDLPLIIQRLHGLSAFSLHSYSPGEINRVASCLRKLGVPPLRTWRHRARSVRARLLSQGGRAATCGRYLFNWAVRTKLKLTPIPAASQLDLSGWFVAGYNGGDIYHSLSRARPRWFMLCLLLLSVGVGIYLLPNR

SEQ ID NO: 41 - protein, 3010 aa, Artificial Sequence
  Recombinant polypeptide
MSTNPKPQRQTKRNTNRRPQDVKFPGGGQIVGGVYLLPRRGPRLGVRATRKTSERPQPRGRRQPIPKARQPEGRAWAQPGYPWPLYANEGMGWAGWLLSPRGSRPSWGPTDPRRRSRNLGRVIDTLTCGFADLMGYIPLVGAPLGGVARALAHGVRVVEDGVNYATGNLPGCSFSIFLLALLSCLTIPASAYEVRNVSGVYHVTNDCSNSSIVYEAADMIMHTPGCVPCVREGNSSRCWVALTPTLAARNASIPTTTIRRHVDLLVGAAAFCSAMYVGDLCGSVFLISQLFTFSPRRYETVQDCNCSLYPGHVSGHRMAWDMMMNWSPTAALVVSQLLRIPQAVVDMVAGAHWGILAGLAYYSMVGNWAKVLIVLLLFAGVDGNTRVSGGEAAKNTMGFASLFVSGPSQKIQLINTNGSWHINSTALNCNESLNTGWLAGLFYHNKFNSSGCPERLASCRPLTDFAQGWGPISHANGSGPDQRPYCWHYPPRPCGIVPAKSVCGPVYCFTPSPVVVGTTDRSGAPTYTWGENETDVFVLNNTRPPMGNWFGCTWMNSTGFTKVCGAPPCAIGGVGNNTLRCPTDCFRKHPEATYSRCGSGPWITPRCMVDYPYRLWHYPCTINYTIFKVRMYVGGVEHRLDAACNWTRGERCNLDDRDRSELSPLLLSTTQWQVLPCSFTPMPALSTGLIHLHQNIVDVQYLYGVGSSIASWAIKWEYVVLLFLLLADARVCSCLWMMLLISQVEAALENLVILNAASLAGTHGLVSFLVFFCFAWYLKGRWVPGAVYALYGMWPLLLLLLALPQRAYALDTEVAASCGGVVLVGLMALTLSPYYKHYISWCMWWLQYFLTRVEAQLHVWVPPLNVRGGRDAVILLTCVVHPTLVFDITKLLLAIFGPLWILQASLLKVPYFVRVQGLLRICALARKMVGGHYVQMAIIKLGALTGTYVYNHLTPLRDWAHNGLQDLAVAVEPVVFSRMETKLITWGADTAACGDIINGLPVSARRGREILLGPADGMASKGWRLLAPITAYAQQTRGLLGCIVTSLTGRDKNQAEGEVQIVSTATQTFLATCINGVCWTVYHGAGTRTIASPKGPVIQMYTNVDKDLVGWPAPQGSRSLTPCTCGASDLYLVTRHADVIPVRRRGDSRGSLLSPRPISYLKGSSGGPLLCPAGHAVGLFRAAVCTRGVAKAVDFIPVENLETTMRSPVFTDNSSPPAVPQSFQVAHLHAPTGSGKSTKVPAAYAAQGYTVLVLNPSVAATLAFGAYMSKAHGIDPNVRTGVRTITTGSPITYSTYGKFLADGGCPGGAYDIIICDECHSTDATTILGVGTVLDQAETAGARLVVLATATPPGSVTVPHSNIEEVALSNVGEIPFYGKAIPIEAIKGGRHLIFCHSKKKCDELAAKLSALGLNAVAYYRGLDVSVIPASGDVVVVATDALMTGYTGDFDSVIDCNTCVTQTVDFSLDPTFTIETTTVPQDAVSRSQRRGRTGRGRGGIYRFVTPGERPSGMFDSSVLCESYDAGCAWYELTPAETSIRLRAYLNTPGLPVCQDHLEFWESVFTGLTHIDAHFLSQTKQSGENLPYLVAYQATVCARAQALPPSWDQMWKCLVRLKPTLHGPTPLLYRLGPVQNEVTLTHPITKFIMACMSADLEVVTSTWVLVGGVLAALAAYCLTTGSVVIVGRIILSGKPAVIPDREVLYQEFDEMEECATHLPYIEQGMQLAEQFKQKALGLLQTASKQAEAAAPVVESKWRALEAFWAKHMWNFISGIQYLAGLSTLPGNPAIVSLMAFTASITSPLTTQHTLLFNILGGWVAAQLAPPSAASAFVGAGIAGAAVGSIGLGKVLVDIIAGYGAGVAGALVAFKVMSGDMPSTEDLVNLLPAILSPGALVVGVVCAAVLRRHVGPGEGAVQWMNRLIAFASRGNHVSPTHYVPESDAAARVTQILSNLTITQLLKRLHQWINEDCSTPCSGTWLRDVWDWICTVLTDFKTWLQSKLLPRLPGVPFLSCQRGYKGVWRGDGIMHTTCPCGAQIAGHVKNGSMRIVGPKTCSNTWHGTFPINAYTTGPCTPSPAPNYSKALWRVAAEEYVEITRVGDFHYVTGMTTDNIKCPCQVPAPEFFTEVDGVRLHRYAPACKPLLRDEVTFQVGLNQYVVGSQLPCEPEPDVTVLTSMLTDPSHITAETAKRRLARGSPPSLASSSASQLSAPSLKATCTTRHDSPDADLIEANLLWRQAMGGNITRVESENKVVILDSFDPLRAEEDEREVSVPAEILRRSRKFPPAMPIWARPDYNPPLVEPWKRPDYEPPLVHGCPLPPAKAPPVPPPRRKRTVVLSESTVSSALAELATKTFGSSESSAVDSGTATAPPDQPSDDGDAGSDVESYSSMPPLEGEPGDPDLSDGSWSTVSEEAGEDVVCCSMSYSWTGALITPCAAEESKLPINALSNSLLRHHNMVYATTSRSASQRQKKVTFDRLQVLDNHYQDVLKEMKAKASTVKARLLSVEEACSLTPPHSARSKFGYGAKDVRNLSGKAVNHIRSVWKDLLEDTDTPIDTTIMAKNEVFCVQPEKGGRKPARLIVFPDLGVRVCEKMALYDVVSKLPVAVMGSSYGFQYSPGQRVEFLVNAWKSKKNPMGFAYDTRCFDSTVTESDIRVEESIYQCCDLAPEARQAIKSLTERLYIGGPLTNSKGQSCGYRRCRASGVLTTNCGNTLTCYLKASAACRAAKLRDCTMLVCGDDLVVICESAGTQEDAASLRVFTEAMTRYSAPPGDPPRPEYDLELITSCSSNVSVAHDATGKRVYYLTRDPTTPIARAAWETARHTPVNSWLGNIIMYAPTLWVRMILMTHFFSILLAQEQLGKALDCQIYGATYSIEPLDLPQIIQRLHGLSAFSLHSYSPGEINRVAACLRKLGVPPLRVWRHRARSVRAKLLSQGGRAAICGRYLFNWAVKTKLKLTPIPAASRLDLSGWFVAGYSGGDIYHSLSRARPRWFMWCLLLLSVGVGIYLLPNR

SEQ ID NO: 42 - protein, 3010 aa, Artificial Sequence; identical to SEQ ID NO: 22
  Recombinant polypeptide

SEQ ID NO: 43 - protein, 3011 aa, Artificial Sequence
  Recombinant polypeptide
MSTNPKPQRKTKRNTNRRPQDVKFPGGGQIVGGVYLLPRRGPRLGVRTTRKTSERSQPRGRRQPIPKARRPEGRTWAQPGYPWPLYGNEGCGWAGWLLSPRGSRPNWGPTDPRRRSRNLGKVIDTLTCGLADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAGTHVTGGSAAKDTSGFTSLFRIGARQNIQLINTNGSWHINSTALNCNASLDTGWIAGLFYYHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSSGFTKVCGAPPCVIGGVGNNTLHCPTDCFRKHPEATYSRCGSGPWITPRCLVNYPYRLWHYPCTINYTIFKVRMYVGGVEHRLEAACNWTRGERCDLDDRDRSELSPLLLSTTQWQVLPCSFTTLPALTTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGQEILLGPADGMVSKGWRLLAPITAYAQQTRGLLGCIVTSLTGRDKNQVEGEVQIVSTAAQTFLATCINGVCWTVYHGAGTRTIASPKGPVIQMYTNVDKDLVGWPAPQGARSLTPCTCGSSDLYLVTRHADVIPVRRRGDGRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYTVLVLNPSVAATLGFGAYMSKAHGIDPNIRTGVRTITTGSPITYSTYGKFLADGGCSGGAYDIIICDECHSTDATSILGIGTVLDQAETAGARLTVLATATPPGSITVPHPNIEEVALSTTGEIPFYGKAIPLEVIKGGRHLIFCHSKRKCDELAAKLVALGINAVAYYRGLDVSVIPASGDVVVVATDALMTGYTGDFDSVIDCNTCVTQTVDFSLDPTFTIETTTLPQDAVSRTQRRGRTGRGKPGIYRFVAPGERPSGMFDSSILCECYDAGCAWYELTPAETTVRLRAYMNTPGLPVCQDHLEFWEGVFTGLTHIDAHFLSQTKQSGENLPYLVAYQATVCARAQALPPSWDQMWKCLTRLKPTLHGPTPLLYRLGAVQNEITLTHPVTKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDIIAGYGAGVAGALVAFKIMSGEVPSTEDLVNLLPAILSPGALVVGVVCAAILRRHVGPGEGAVQWMNRLIAFASRGNHVSPTHYVQESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVVLDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSGADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVYPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPINSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVKTKLKLTPIAAAGQLDLSGWFTAGYSGGDIYHSVSHARPRWFWFCLLLLAAGVGIYLLPNR

SEQ ID NO: 44 - protein, 3011 aa, Artificial Sequence
  Recombinant polypeptide
MSTNPKPQRKTKRNTNRRPQNVKFPGGGQIVGGVCLLPRRGPRVGVRATRKTSERSQPRGRRQPIPKARRPEGRSWAQPGYPWPLYGNEGCGWAGWLLSPRGSRPSRGPSDPRRRSRNLGKVIDTLTYGFADLMGYIPLVGAPLGGAARALAHGVRVLEDGVNYATGNLPGCSFSIFLLALLSCLTVPASAVGVRNSSGVYHVTNDCPNASVVYETDSLIIHLPGCVPCVREGNGSRCWVSLSPTVAAKDPGVPVNEIRRHVDLIAGAAAFCSAMYVGHLCGSIFLVGQLFTLSPRRHWTTQDCNCSIYPGHVTGHRMAWDMMMNWSPTGALVVAQLLRIPQAVLDMIAGAHWGVLAGPAYYSMVGNWAKVVVVLLLFAGVDATTQVTGGTAGRNAYRLASLFSTGPSQNIQLINSNGSWHINRTALNCNDSLHTGWVAALFYSHKFNSSGRPERMASCRPLTAFDQGWGPITHEGNASDDQRPYCWHYALRPCGIVPAKKVCGPVYCFTPSPVVVGTTDRAGVPTYRWGANETDVLLLNNSRPPMGNWFGCTWMNSSGFTKTCGAPACNVGGSETNTLSCPTDCFRRHPDATYAKCGSGPWLNPRCMVDYPYRLWHYPCTVNYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEAALENLIVLNAASLVGTHGIVPFFIFFCAAWYLKGKWAPGLAYSVYGMWPLLLLLLALPQRAYALDQELAASCGATVFICLAVLTLSPYYKQYMARGIWWLQYMLTRAEALLQVWVPPLNARGGRDGVVLLTCVLHPHLLFEITKIMLAILGPLWILQASLLRVPYFVRAHGLIRLCMLVRKTAGGHYVQMALLKLGALTGTYIYNHLSPLQDWAHSGLRDLAVATEPVIFSRMEIKTITWGADTAACGDIINGLPVSARRGREVLLGPADALTDKGWRLLAPITAYAQQTRGLLGCIVTSLTGRDKNQVEGEIQIVSTATQTFLATCINGACWTVYHGAGSRTIASASGPVVRMYTNVDQDLVGWPAPQGARSLTPCTCGASDLYLVTRHADVIPVRRRGDNRGSLLSPRPISYLKGSSGGPLLCPMGHAVGIFRAAVCTRGVAKAVDFVPVESLETTMRSPVFTDNSSPPTVPQSYQVAHLHAPTGSGKSTKVPAAYAAQGYKVLVLNPSVAATLGFGAYMSKAHGIDPNVRTGVRTITTGSPITHSTYGKFLADGGCPGGAYDIIICDECHSVDATSILGIGTVLDQAETAGVRLTVLATATPPGLVTVPHSNIEEVALSADGEKPFYGKAIPLNYIKGGRHLIFCHSKKKCDELAAKLVGLGVNAVAFYRGLDVSVIPTTGDVVVVATDALMTGFTGDFDSVIDCNTCVVQTVDFSLDPIFSIETSTVPQDAVSRSQRRGRTGRGKHGIYRYVSPGERPSGMFDSVVLCECYDAGCAWYELTPAETTVRLRAYLNTPGLPVCQDHLEFWESVFTGLTHIDAHFLSQTKQSGENFPYLVAYQATVCARARAPPPSWDQMWKCLIRLKPTLTGATPLLYRLGSVQNEITLTHPITQYIMACMSADLEVVTSTWVLVGGVLAALAAYCLSTGSVVIVGRIILGGKPAVIPDREVLYREFDEMEECAAHVPYLEQGMHLAEQFKQKALGLLQTASKQAETITPTVRTNWQKLESFWAKHMWNFVSGIQYLAGLSTLPGNPAIASLMSFTAAVTSPLTTQQTLLFNILGGWLAAQLAAPAAATAFVGAGITGAVVGSVGLGKVLVDILAGYGAGVAGALVAFKIMSGETPTTEDLVNLLPAILSPGALVVAVVCAAILRRHVGLGEGAVQWMNRLIAFASRGNHVSPTHYVPESDASARVTQILTSLTVTQLLKRLHVWISSDCIAPCASSWLKDVWDWICEVLSDFKNWLKAKLVPQLPGIPFVSCQRGYRGVWRGEGIVHTRCPCGANITGHVKNGSMRIVGPKTCSNTWRGSFPINAHTTGPCTPSPAPNYTFALWRVSAEEYVEVRRLGDFHYVTGVTTDKLKCPCQVPSPEFSTEVDGVRLHRYAPPCKPLLRDEVTFSIGLNEYLVGSQLPCEPEPDVAALTSMLTDPSHITAETAARRLKRGSPPSLASSSASQLSAPSLKATCTTHHDSPDADLIEANLLWRREMGGNITRVESENKIVVLDSFDPLVAEEDDREISIPAEILRKFKQFPPAMPIWARPDYNPPLVEPWKRPDYEPPLVHGCPLPPPKPTPVPPPRRKRTVVLDESTVSSALAELATKTFGSSTTSGVTSGEAAESSPALSCDGELDSEAESYSSMPPLEGEPGDPDLSDGSWSTVSSDGGTEDVVCCSMSYSWTGALITPCAAEETKLPINALSNSLLRHHNLVYSTTSRSAGQRQKKVTFDRVQVLDDHYRDVLKEAKAKASTVKARLLSVEEACSLTPPHSARSKFGYGPKDVRSHSSKAIRHINSVWQDLLEDNTTPIDTTIMAKNEVFCVKPEKGGRKPARLIVYPDLGVRVCEKRALYDVVKQLPIAVMGPSYGFQYSPAQRVDFLLNAWKSKKNPMGFSYDTRCFDSTVTEADIRTEEDLYQSCDLVPEARAAIRSLTERLYIGGPLTNSKGQNCGYRRCRASGVLTTSCGNTITCYLKASAACRAAKLRDCTMLVCGDDLVVICESAGVKEDAASLRAFTEAMTRYSGPPGDPAQPEYDLELITSCSSNVSVARDGAGKRVYYLTRDPETPLARAAWETARHTPVNSWLGNIIMFAPTLWVRMVLMTHFFSILIAQEHLEKALDCEIYGAVHSVQPLDLPEIIQRLHSLSAFSLHSYSPGEINRVAACLRKLGVPPLRAWRHRARSVRATLLSQGGKAAICGKYLFNWAVKTKLKLTPLPSMSQLDLSNWFTGGYSGGDIYHSVSHVRPRWFFWCLLLLSVGVGIYLLPNR

SEQ ID NO: 45 - protein, 3010 aa, Artificial Sequence; identical to SEQ ID NO: 22
  Recombinant polypeptide

SEQ ID NO: 46 - protein, 3011 aa, Artificial Sequence; identical to SEQ ID NO: 43
  Recombinant polypeptide

SEQ ID NO: 47 - protein, 3011 aa, Artificial Sequence; identical to SEQ ID NO: 44
  Recombinant polypeptide

SEQ ID NO: 48 - protein, 3011 aa, Artificial Sequence
  Recombinant polypeptide
MSTNPKPQRKIKRNTNRRPQDVKFPGGGQIVGGVYLLPRRGPRLGVRAPRKTSERSQPRGRRQPIPKARRPEGRAWAQPGYPWPLYGNEGLGWAGWLLSPRGSRPSWGPNDPRRRSRNLGKVIDTLTCGFADLMGYIPLVGAPLGGVARALAHGVRVVEDGVNYATGNLPGCSFSIFLLALLSCLTVPASAYQVRNSSGLYHVTNDCSNASIVYEAADVIMHTPGCVPCVREGNSSRCWVALTPTLAARNSSIPTTTIRRHVDLLVGAAALCSAMYVGDFCGSVFLVSQLFTFSPRRYETVQDCNCSLYPGHVSGHRMAWDMMMNWSPTAALVVSQLLRIPQAIMDMVAGAHWGVLAGLAYYSMAGNWAKVLIVMLLFAGVDGGTHVTGGKVAYTTQGFTSFFSRGPSQKIQLVNTNGSWHINRTALNCNDSLNTGFLAALFYTHKFNASGCPERMASCRSIDKFDQGWGPITYAEPHDLDQRPYCWHYPPQPCGIVPAAQVCGPVYCFTPSPVVVGTTDRSGAPTYNWGENETDVFILNNTRPPQGNWFGCTWMNGTGFTKTCGGPPCNIGGAGNNTLICPTDCFRKHPEATYAKCGSGPWLTPRCLVHYPYRLWHYPCTVNFTVFKVRMYVGGVEHRLHAACNWTRGERCNLEDRDRSELSPLLLSTTEWQVLPCSFTTLPALSTGLIHLHRNIVDVQYLYGVGSSIVSWAIKWEYVILLFLLLADARICSCLWMMLLISQAEAALENLVVLNAASVAGTHGILSLLVFFCAAWYIKGKLVPGAAYAFYGVWPLLLLLMALPARAYAMDREMAASCGGAVFVGLVLLTLSPYYKVFLAKLIWWLQYFITRAEAHLQVWVPPLNVRGGRDAIILLTCAIHPELIFTITKILLAILGPLMVLQAGLTQMPYFVRAQGLIRACMLVRKAAGGHYVQMALMKLAALTGTYVYDHLTPLQDWAHVGLRDLAVAVEPVIFSDMETKIITWGAETAACGDIISGLPVSARRGKEILLGPADSFGEQGWRLLAPITAYSQQTRGLFGCIITSLTGRDRNQVEGEVQVVSTATQSFLATCINGVCWTVFHGAGSKTLAGPKGPVTQMYTNVDQDLVGWPAPPGARSMTPCTCGSSDLYLVTRHADVVPVRRRGDSRGSLLSPRPVSYLKGSSGGPLLCPSGHVVGIFRAAVCTRGVAKAVDFIPVESMETTMRSPVFTDNSSPPVVPQSFQVAYLHAPTGSGKSTRVPAAYAAQGYKVLVLNPSVAATLSFGAYMSKAYGTDPNIRTGVRTITTGASITYSTYGKFLADGGCSGGAYDIIMCDECHSTDSTSILGIGTVLDQAETAGARLVVLATATPPGSVTVPHSNIEEVALSNIGEIPFYGKAIPIEAIKGGRHLIFCHSKKKCDELAAKLSALGVNAVAYYRGLDVSVIPTSGNVVVVATDALMTGYTGDFDSVIDCNTCVIQTVDFSLDPTFTIDTTTVPQDAVSRTQRRGRTGRGRGGIYRFVTPGERPSGMFDSSVLCECYDAGCAWYELTPAVTSVRLRAYLNTPGLPVCQVHLEFWESVFTGLTHIDAHFLSQTKQAGENFPYLTAYQATVCARSQAPPPSWDQMWKCLIRLKPTLHGATPLLYRLGAVQNEITLTHPITKFIMACMSADLEIVTSTWVLVGGVLAALAAYCLSTGCVVIVGRVVLSGKPAIIPDREVLYKEFDEMEECSQHLPYIEQGMALAEQFKQKALGLLQTASRQAEVITPAVQTNWQKLEVFWAKHMWNFISGVQYLAGLSTLPGNPAIASLMAFTASVTSPLTTQSTLLFNILGGWVAAQLAPPSAASAFVGAGIAGAAIGSIGLGKVLVDILAGYGAGVAGALVAFKVMSGDMPSTEDLVNLLPAILSPGALVVGVVCAAILRRHVGPGEGAVQWMNRLIAFASRGNHVSPTHYVPESDAAARVTTILSSLTVTQLLRRLHQWISSDCTTPCSGSWLKDVWDWICTVLSDFKTWLQTKLLPRLPGVPFLSCQRGYKGVWRGDGIMHTTCPCGAQIAGHVKNGSMRIVGPRTCSNTWHGTFPINAYTTGPCVPSPAPNYSKALWRVAAEEYVEVTRVGDSHYVTGMTTDNIKCPCQVPAPEFFTELDGVRLHRYAPACKPLLRDEVTFQVGLNQYVVGSQLPCEPEPDVTVLTSMLTDPSHITAEAARRRLARGSPPSLARSSASQLSAPSLKATCTTRHDSPDADLIEANLLWRQEMGGNITRVESENKVVILDSFEPLRAEEDEREVSVAAEILRKTRKFPAAMPVWARPDYNPPLIESWKDPDYVPPVVHGCPLPPIKAPPIPPPRRKRTVVLSESTVSSALAELATKTFGSSGSSAVDSGTATAPPDQASDDGDKGSDVESYSSMPPLEGEPGDPDLSDGSWSTVSSEAGTEDVVCCSMSYTWTGALITPCAAEESKLPINPLSNSLLRHHSMVYSTTSRSASLRQKKVTFDRLQVLDNHYQDVLKEMKAKASTVKAKLLSIEEACKLTPPHSAKSKFGYGAKDVRSLSSRAVNHIRSVWEDLLEDTETPIDTTIMAKSEVFCVQPEKGGRKAARLIVFPDLGVRVCEKMALYDVVSKLPLAVMGSSYGFQYSPKQRVEFLVNTWKSKKCPMGFSYDTRCFDSTVTESDIRVEESIYQCCDLAPEARQAIKSLTERLYIGGPLTNSRGENCGYRRCRASGVLTTSCGNTLTCYIKAQAACRAAGLRDCTMLVNGDDLVVICESAGTQEDEASLRVFTEAMTRYSAPPGDPPKPEYDLELITSCSSNVSVAHDATGKRVYYLTRDPATPLARAAWETVRHTPVNSWLGNIIMYAPTLWARMVLMTHFFSILLAQEQLDKALDCQIYGATYSIEPLDLPQIIERLHGLSAFSLHSYSPGEINRVAACLRKLGVPPLRVWRHRARSVRARLLSQGGRAAICGRYLFNWAVKTKLKLTPIAAASQLDLSGWFTAGYSGGDIYHSVSRARPRWFMLCLLLLSVGVGIYLLPNR

SEQ ID NO: 49 - protein, 3019 aa, Artificial Sequence
  Recombinant polypeptide
MSTLPKPQRKTKRNTNRRPQDVKFPGGGQIVGGVYLLPRRGPRLGVRAVRKTSERSQPRGRRQPIPKARQPQGRHWAQPGYPWPLYGNEGMGWAGWLLSPRGSRPNWGPNDPRRRSRNMGKVIDSLTCGFADLMGYIPVLGAPLGGVAAALAHGVRAIEDGINYATGNLPGCSFSIFLLALLSCLTTPASALTYGNSSGLYHLTNDCPNSSIVLEADAMILHLPGCLPCVRVDNRSTCWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTIGHEVGRASATLAGMFSSGARQNLQLINTNGSWHINSTALNCNDSLQTGFIASLFYAHRFNSSGCPERMAACKPLADFRQGWGQITYKVNISGPSDDRPYCWHYAPRPCGIVPASEVCGPVYCFTPSPVVVGTTDRSGVPTYNWGENETDVFMLESLRPPTGGWFGCTWMNSSGFTKTCGAPPCQIVPGDYNSSANELLCPTDCFRKHPEATYQRCGSGPWLTPRCLVDYPYRLWHYPCTVNFTLHKVRMFVGGIEHRFDAACNWTRGERCELHDRDRIEMSPLLFSTTQLAILPCSFTTMPALSTGLIHLHQNIVDVQYLYGVSSSVTSWVVKWEYIVLMFLVLADARICTCLWLMLLISNVEAAVERLVVLNAASAAGTAGWWWAVLFLCCVWYVKGRLVPACTYMALGMWPLLLTILALPPRAYAMDNEQAASLGAVGLLVITIFTITPMYKKLLTCFIWWNQYFLARAEAMIHEWVPDLRVRGGRDSIILLTCLLHPQLGFEVTKILLAILAPLYILQYSLLKVPYFVRAHILLRACLLVRRLAGGKYVQACLLRLGAWTGTFVYDHLTPLSDWASDGLRDLAVAVEPVIFSPMEKKVITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDQDLVGWPAPQGTRSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQSYQVGYLHAPTGSGKSTRVPAAYASQGYKVLVLNPSVAATLSFGSYMRQAYGVEPNVRTGVRTITTGGAITYSTYGKFFADGGCSGGAYDVIICDECHSTDPTTVLGIGTVLDQAETAGCRLTVLATATPPGSITVPHPNITESALPTTGEVPFYGKAIPIEVIKGGRHLIFCHSKKKCDELAKQLTSLGLNAVAFYRGVDVSVIPTSGDVVVCATDALMTGFTGDFDSVIDCNVSVTQVVDFSLDPTFSIETTTVPQDAVSRTQRRGRTGRGKPGVYRFVSQGERPSGMFDTVVLCEAYDTGCAWYELSPSETTVRLRAYLNTPGLPVCQDHLEFWEGVFTGLTHIDAHFLSQTKQGGENFAYLTAYQATVCARALAPPPSWDTMWKCLIRLKPTLTGPTPLLYRLGAVQNEIITTHPITKYIMTCMSADLEVITSTWVLVGGVLAALAAYCLSVGCVVICGRITLTGKPAVVPDREILYQQFDEMEECSRHIPYLAEGQQIAEQFRQKVLGLLQASAKQAEELKPAVHSAWPKLEQFWQKHLWNFVSGIQYLAGLSIWPGNPAVASLMSFSASLTSPLSTSTTLLLNILGGWIATQVAPPPASTAFVVSGLAGATVGSIGLGRVLVDVLAGYGAGVSGALVAFKIMSGECPTTEDMVNLLPALLSPGALVVGVVCPAILRRHVGPAEGANQWMNRLIAFASRGNHGSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPTHITAETAARRLKRGSPPSLASSSASQLSAPSLKATCTTSKDHPDMELIEANLLWRQEMGSNITRVESENKVVVLDSFEPLTAEYDEREISVSAECHRPPRHKFPPALPIWARPDYNPPLLQAWQMPGYEPPVVSGCAVAPPKPAPIPPPRRKRLVHLDESTVSHALAQLADKVFVESSNDPGPSSDSGLSITSPVPPAPSTPDDACSEAESYSSMPPLEGEPGDPDLSSGSWSTVSDQDDVVCCSMSYTWTGALITPCAAEEEKLPINPLSNSLIRHHNMVYSTTSRSASLRQKKVTFDRVQVFDQHYQDVLKEIKLRASTVQARLLSIEEACDLTPSHSARSKYGYGAQDVRSHASKAINHIRSVWEDLLEDSDTPIPTTIMAKNEVFCVDPSKGGRKPARLIVYPDLGVRVCEKMALYDVTQKLPQAVMGSAYGFQYSPNQRVEYLLKMWRSKKVPMGFSYDTRCFDSTVTERDIRTENDIYQSCQLDPVARKAVSSLTERLYVGGPMFNSKGQTCGYRRCRASGVLPTSMGNTITCYLKAQAACRAANIKDCDMLVCGDDLVVICESAGVQEDTASLRAFTDAMTRYSAPPGDAPQPTYDLELITSCSSNVSVAHDGNGKRYYYLTRDCTTPLARAAWETVRHSPVNSWLGNIIMFAPTIWVRMVLMTHFFSILQSQEQLEKALDFDIYGVTYSVSPLDLPAIIQRLHGMAAFSLHGYSPGELNRVAACLRKLGAPPLRAWRHRARAVRAKLIAQGGKAAICGKYLFNWAVRTKLKLTPLVSASKLDLSGWFVAGYDGGDIYHSVSQARPRLLLLGLLLLTVGVGIFLLPAR

SEQ ID NO: 50 - protein, 3033 aa, Artificial Sequence
  Recombinant polypeptide
MSTNPKPQRITKRNINRRPQDVKFPGGGVIYVGVYVLPRRGPKLGVRATRKTSERPQPRGRRQPIPKARRSEGRSWAQPGYPWPLYGNEGCGWAGWLLSPRGSRPTWGPTDPRHRSRNLGKVIDTLTCGLADLMGYIPVVGAPVGGVARALAHGVRAVEDGINYATGNLPGCSFSIFLLALLSCVTVPVSAVEVRNISSSYYATNDCSNNSITWQLTNAVLHLPGCVPCENDNGTLRCWIQVTPNVAVKHRGALTHNLRTHVDMIVMAATVCSALYVGDVCGAVMIVSQALIVSPERHNFTQECNCSIYQGHITGHRMAWDMMLNWSPTLTMILAYAARVPELVLEIVFGGHWGVVFGLAYFSMQGAWAKVIAILLLVAGVDATTYSTGAQAGRGASGIANLFTPGAKQNIQLINTNGSWHINRTALNCNASLDTGWVAGLFYYHKFNSSGCPERMSSCRGLDDFRIGWGTLEYETNVTNDEDMRPYCWHYPPKPCGIVPARSVCGPVYCFTPSPVVVGTTDRLGVPTYTWGENETDVFLLNSTRPPRGAWFGCTWMNSTGFTKTCGAPPCRIRADFNASTDLLCPTDCFRKHPDATYLKCGAGPWLTPRCLVNYPYRLWHYPCTVNFTIFKVRMYVGGVEHRLSAACNFTRGDRCRLEDRDRGQQSPLLHSTTEWAVLPCSFSDLPALSTGLLHLHQNIVDVQYLYGVGSAVVSWALKWEYVVLAFLLLADARVCACLWMLIILGQAEAALEKLIILHSASAASANGPLWFFIFFTAAWYLKGRVVPVATYSVLGLWSFLLLVLALPQQAYALDAAEQGELGLVILVIISIFTLTPAYKILLSRSVWWLSYMLVLAEAQIQQWVPPLEARGGRDGIIWVAVILHPRLVFEVTKWLLALLGPAYLLKASLLRVPYFVRAHALLRVCTLVRHLAGARYIQMLLITIGRWTGTYIYDHLSPLSTWAAQGLRDLAVAVEPIIFSPMEKKVIVWGAETVACGDILHGLPVSARLGREVLLGPADGYTSKGWKLLAPITAYSQQTRGLLGAIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGIFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGGAITYSTYGKFLADGGCAGGAYDIIICDECHSVDATTILGIGTVLDQAETAGVRLTVLATATPPGSVTTPHPNIEEVALGQEGEIPFYGRAIPLSYIKGGRHLIFCHSKKKCDELAAALRGMGLNAVAYYRGLDVSVIPTQGDVVVVATDALMTGFTGDFDTVIDCNVAVTQVVDFSLDPTFTIETTTMPQDAVSRSQRRGRTGRGRGGIYRFVTPGERPSAMFDSSVLCECYDTGCAWYELTPSETTVRLRAYFNTPGLPVCQDHLEFWEAVFTGLTHIDAHFLSQTKQSGENFPYLVAYQATVCARAKAPPPSWDVMWKCLTRLKPTLVGPTPLLYRLGSVTNEVTLTHPVTKYIATCMQADLEVMTSTWVLAGGVLAAVAAYCLATGCVSIIGRLHINQRAVVAPDKEVLYEAFDEMEECASRAALIEEGQRIAEMLKSKIQGLLQQASKQAQDIQPAIQSSWPKLEQFWAKHMWNFVSGIQYLAGLSTLPGNPAVASMMAFSAALTSPLSTSTTILLNIMGGWLASQIAPPAGATGFVVSGLVGAAVGSIGLGKILVDVLAGYGAGISGALVAFKIMSGEKPSVEDVVNLLPAILSPGALVVGVICAAILRRHVGQGEGAVQWMNRLIAFASRGNHVAPTHYVAESDASQRVTQVLSSLTITSLLRRLHAWITEDCPVPCSGSWLRDIWDWVCSILTDFKNWLTSKLFPKMPGLPFISCQKGYRGVWAGTGIMTTRCPCGANISGNVRLGSMRITGPKTCMNTWQGTFPINCYTEGQCVPKPAPNFKTAIWRVAASEYVEVTQHGSFSYVTGLTSDNLKVPCQLPSPEFFSWVDGVQIHRFAPTPKPFFRDEVSFCVGLNSFVVGSQLPCDPEPDTEVLASMLTDPSHITAEAAARRLARGSPPSQASSSASQLSAPSLRATCTTHGKTYDVDMVDANLFMGGDVTRIESDSKVIVLDSLDSMTEVEDDREPSVPSEYLIRRRKFPPALPPWARPDYNPPVIETWKRPGYEPPTVLGCALPPTPQAPVPPPRRRRAKVLTQDNVEGVLREMADKVLSPLQDHNDSGHSTGADTGGDSVQQPSDETAASEAGSLSSMPPLEGEPGDPDLEFEPAGSAPPSEGECEVIDSDSKSWSTVSDQEDSVICCSMSYSWTGALITPCGPEEEKLPISPLSNSLMRFHNKVYSTTSRSASLRAKKVTFDRVQVLDAHYDSVLKDIKLAASKVSARLLSVEEACALTPPHSAKSKFGYGAKDVRSHSRKAINHINSVWEDLLEDQHTPIDTTIMAKNEVFCVDPTKGGKKAARLIVYPDLGVRVCEKRALYDIAQKLPKAVMGPSYGFQYSPAQRVDFLLNAWKSKKNPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPIMLVCGDDLVVISESQGNEEDERNLRAFTEAMTRYSAPPGDLPRPEYDLELITSCSSNVSVALDSRGRRRYFLTRDPTTPIARAAWETVRHSPVNSWLGNIIQYAPTIWVRMVIMTHFFSILLAQDTLNQNLNFEMYGAVYSVNPLDLPAIIERLHGLDAFSLHTYSPHELSRVAATLRKLGAPPLRAWKSRARAVRASLIAQGGRAAICGRYLFNWAVKTKLKLTPLPEASRLDLSGWFTVGAGGGDIFHSVSHARPRLLLLCLLLLSVGVGIFLLPAR

SEQ ID NO: 51 - protein, 3010 aa, Artificial Sequence
  Recombinant polypeptide
MSTNPKPQRQTKRNTNRRPQNVKFPGGGQIVGGVYLLPRKGPRLGVRAPRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRALEDGINFATGNLPGCSFSIFLLALLSCLTIPASAIEVRNVSGVYHVTNDCSNASIVYEAADMIMHTPGCVPCVREGNSSRCWVALTPTLAARNSSIPTTTIRRHVDLLVGTAAFCSAMYVGDLCGSVFLVSQLFTFSPRRYETVQDCNCSIYPGHVSGHRMAWDMMMNWSPTTALVVSQLLRIPQAVVDMVAGAHWGVLAGLAYYSMVGNWAKVLIVMLLFAGVDGNTHVTGGQAGQHAIRFTSLFSSGASQKIQLVNSNGSWHINRTALNCNDSLQTGFLAALFYTHRFNASGCPERMASCRPIDKFAQGWGPITYAEPPDLDQKPYCWHYAPQPCGIVPASQVCGPVYCFTPSPVVVGTTDRFGVPTYSWGENETDVLLLNNTRPPRGNWFGCTWMNGTGFTKTCGGPPCNIGGVGNDTLICPTDCFRKHPEATYAKCGSGPWLTPRCMVDYPYRLWHYPCTLNFSIFKIRMYVGGVEHRLNAACNWTRGERCDLEDRDRSELSPLLLSTTEWQILPCSFTTLPALSTGLIHLHRNIVDVQYLYGIGSAVVSFAIKWEYVLLLFLLLADARVCACLWMMLLIAQAEAALENLVVLNAASVAGTHGILSFLVFFCAAWYIKGRLVPGAAYALYGVWPLLLLLLALPPRAYAMDREMAASCGGAVFIGLALLTLSPHYKVFLARLIWWSQYLITRAEAHLQVWVPPLNVRGGRDAIILLMCAIHPELIFTITKILLAILGPLMVLQAGITRVPYFVRAHGLIRACMLVRKAAGGHYVQMALMKLAALTGTYVYDHLTPLRDWAHAGLRDLAVAVEPVVFSDMETKVITWGADTAACGDIILGLPVSARRGREILLGPADSLEGQGWRLLAPITAYAQQTRGLLGTIVTSLTGRDTNENCGEVQVLSTATQSFLATCVNGVCWTVYHGAGTKTLAGQKGPITQMYTNVDQDLVGWPAPPGARSMTPCTCGSSDLYLVTRHADVIPVRRRGDSRGSLLSPRPISYLKGSSGGPLLCPSGHVVGIFRAAVCTRGVAKAVDFVPVESMETTMRSPVFTDNSTPPAVPQTYQVAHLHAPTGSGKSTKVPAAYAAQGYKVLVLNPSVAATLGFGAYMSKAHGVDPNIRTGVRTITTGSSITYSTYGKFLADGGCSGGAYDIIMCDECHSTDSTSILGIGTVLDQAETAGVRLVVLATATPPGSVTVPHPNIEEVALSNTGEIPFYGKAIPLEAIKGGRHLIFCHSKKKCDELAAKLSALGVNAVAYYRGLDVSIIPTSGDVVVVATDALMTGYTGNFDSVIDCNVAVTQIVDFSLDPTFTITTQTVPQDAVSRSQRRGRTGRGRLGIYRYVSSGERPSGMFDSVVLCECYDAGAAWYELTPAETSVRLRAYLNAPGLPVCQDHLEFWEGVFTGMTHIDAHFLSQTKQAGDNFPYLVAYQATVCARAQAPPPSWDQMWKCLIRLKPTLHGPTPLLYRLGAVQNEVTLTHPITKFIMACMSADLEVATSTWVLVGGVLAALAAYCLSVGSVVIVGRIILSGRPAVIPDREVLYQQFDEMEECATHLPYIEQGMQLAEQFKQKALGLLQTASKQAEAAAPVVESKWRALESFWAKHMWNFISGIQYLAGLSTLHGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPALLSPGALVVGVVCAAILRRHAGPAEGATQWMNRLIAFASRGNHVSPTHYVPESDAAARVTQILSSLTITQLLKRLHQWINEDCSTPCSGSWLRDVWDWICTVLSDFKTWLQSKLLPRLPGVPFLSCQRGYKGVWRGDGVMQTTCPCGAQIAGHVKNGSMRIVGPRTCSNTWHGTFPINAYTTGPCTPSPAPNYSRALWRVAAEEYVEVTRVGDFHYVTGMTADNIKCPCQVPAPEFFTELDGVRLHRYAPACRPLLRDEVTFQVGLNQYPVGSQLPCEPEPDVSVLTSMLRDPSHITAEAARRRLARGSPPSEASSSASQLSAPSLKATCTTRHDSPDADLIEANLLWRQEMGGNITRVESETKVVILDSFEPLRAEEDEREVSVPAEILRRSRKFPRAMPIWARPDYNPPLVESWKDPDYVPPVVHGCPLPPAKAPPIPPPRRKRTVVLTESTVSSALAELATKTFGSSESSAVDSGTATAPPDQPSDDGDAGSDVGSYSSMPPLEGEPGDPDLSDGSWSTVSEEASEDVVCCSMSYTWTGALITPCSAEESKLPINALSNSLLRRHNMVYATTSRSASQRQKKVTFDRMQVLDDHYRDVLKEMKAKASTVKAKLLSVEEACKLTPPHSARSKFGYGAKDVRNLSSKAVNHIRSVWKDLLEDTETPLDTTVMAKNEVFCVQPEKGGRKPARLIVYPDLGVRVCEKMALYDVTRKLPQAVMGASYGFQYSPGQRVEFLVNAWKSKKSPMGFAYDTRCFDSTVTESDIRVEESIYQCCDLAPEARQAIRSLTERLYIGGPLTNSKGQNCGYRRCRASGVLTTSCGNTLTCYIKAQAACRAAGLRDCTMLVCGDDLVVICESAGVQEDAASLRAFTEAMTRYSAPPGDPPRPEYDLELITSCSSNVSVAHDGTGQRYYYLTRDPTGPLARAAWETARHTPVNSWLGNIIMYAPTIWVRMVLCTHFFQILQAQEQLHKALDFDMYGVTYSITPLDLPQIIQRLHGLSAFTLHSYSPGEINRVAACLRKLGVPPLRVWRHRARSVRARLLSQGGRAATCGKYLFNWAVKTKLKLTPIAAASQLDLSGWFVAGYSGGDIYHSVSRARPRWFMWCLLLLSVGVGLFLLPAR

SEQ ID NO: 52 - protein, 3029 aa, Artificial Sequence
  Recombinant polypeptide
MSTNPKPQRKTQRNTNRRPTDVKFPGGGQIVGGVYLLPRRGPRLGVRATRKTSERSQPRGRRQPIPKARRPEGRTWAQPGYPWPLYGNEGMGWTGWLLSPRGSRPSWGPTDPRRRSRNLGKVIDTITCGFADLMGYIPVLGGPLGGVAAALAHGVRVLEDSVNYATGNLPGCPFSIFLLALLSCLTIPASAYEVRNVSGIYHVTNDCSNSSIVYEADHHILHLPGCVPCVRENNSSRCWVALTPTLAARNASVPTTTIRRHVDLLVGAAAFCSAMYVGDLCGSVFLISQLFTFSPRRHETVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLNTGFLAALFYTHKFNASGCPERMASCRPLADFDQGWGPISHVVPNISDQRPYCWHYAPRPCSVVSASTVCGPVYCFTPSPVVVGTTDRFGAPTYSWGENETDVLLLNNTRPPQGNWFGCTWMNGTGFTKTCGVPPCNIGGVGNNTLTCPTDCFRKHPEATYTKCGSGPWLTPRCIVDYPYRLWHYPCTINYTIFKVRMYVGGVEHRLDAACNWTRGERCNLEDRDRSELSPLLLSTTEWQVLPCSFTTLPALSTGLIHLHQNVVDVQYLYGVGSSIVSWAIKWEYVILLFLLLADARICSCLWMMLLISQAEAALENLVILNAASVAGAHGILSFLVFFCAAWYIKGKLVPGAAYAFYGVWPLLLLLLALPPRAYALDREMAASCGGAVFVGLVLLTLSPYYKVFLARLIWWLQYFITRAEAHLQVWIPPLNVRGGRDAIILLTCAVHPELIFDITKLLLAILGPLMVLQAGMTRVPYFVRAQGLIRACMLVRKVAGGHYVQMAFMKLAALTGTYVYDHLTPLQDWAHTGLRDLAVAVEPVVFSDMETKIITWGADTAACGDIISGLPVSARRGKEILLGPADSFGEQGWRLLAPITAYSQQTRGLLGCIVTSLTGRDKNQVEGEVQVVSTATQSFLATCINGVCWTVFHGAGSKTLAGPKGPITQMYTNVDQDLVGWQAPPGARSLTPCTCGASDLYLVTRNADVIPVRRRGDGRGSLLSPRPVSYLKGSSGGPLLCPSGHAVGIFRAAVCTRGVAKAVDFIPVESLETTMRSPVFTDNSSPPAVPQTFQVAHLHAPTGSGKSTKVPAAYVAQGYSVLVLNPSVAATLGFGAYMSKAYGIDPNIRSGVRTITTGAPITYSTYGKFLADGGCSGGAYDIIICDECHSTDSTTILGIGTVLDQAETAGARLVVLATATPPGTVTTPHSNIEEVALGHEGEIPFYGKAIPIETIKGGRHLIFCHSRKKCDELAAKLSGLGLNAVAYYRGLDVSVIPTSGNVVVVATDALMTGYTGDFDSVIDCNTCVTQTVDFSLDPTFTIETTTVPQDAVARSQRRGRTGRGRRGIYRFVTPGERPSGMFDSSVLCECYDAGAAWYELTPAETTTRLRAYFNTPGLPVCQDHLEFWESVFTGLTHIDAHFLSQTKQAGENFAYLVAYQATVCARAKAPPPSWDQMWKCLTRLKPTLHGPTPLLYRLGSVQNEVTLTHPITKYIMACMSADLEVVTSTWVLVGGVLAALAAYCLTTGSVVIVGRIILSGKPAVIPDREVLYQEFDEMEECASHLPYIEQGMQLAEQFRQKALGLLQTATKQAEAAAPVVESKWRALETFWAKHMWNFISGIQYLAALSTLPGNPAVASLMAFTASVTSPLTTQSTLLFNILGGWVASQLANPTASTAFVVSGLAGAAVGSVGLGKILVDILAGYGAGISGALVAFKIMSGEKPSMEDVVNLLPGILSPGALVVGVVCAAVLRRHVGPSEGAAQWMNRLIAFASRGNHVAPTHYVTESDASQRVTQLLGSLTITSLLRRLHNWITEDCPIPCAGSWLRDVWDWICTVLTDFKTWLQSKLMPRLPGVPFFSCQRGYKGVWRGDGIMQTTCPCGAQITGHVKNGSMRIVGPKTCSNTWHGTFPINAYTTGPGVPVPAPNYKFALWRVSAEEYVEVRRVGDFHYVTGMTTDNVKCPCQVPAPEFFTEVDGVRLHRYAPACKPLLREEVTFQVGLNQYLVGSQLPCEPEPDVTVLTSMLTDPSHITAETAKRRLARGSPPSLARSSASQLSAPSLKATCTTHHDSPDADLIEANLLWRQEMGNNITRVESENKVVILDSFDPLRAEEDEREVSVAAEILRKSRKFPPALPVWARPDYNPPLLESWKDPDYVPPVVHGCPLPPTKAPPIPPPRRKRTVVLTESNVSSALAELATKTFGSSGSSAVDSGTATAPPDQASDDGDKGSDVESYSSMPPLEGEPGDPDLEPEQVELQPPPQGGEVAPGSDSGSWSTCSEEDDSVVCCSMSYSWTGALITPCAAEESKLPINPLSNSLLRHHNMVYATTSRSAGLRQKKVTFDRLQVLDDHYRDVLKEMKAKASTVKAKLLSIEEACKLTPPHSAKSRYGFGAKEVRSLSRRAVNHIRSVWEDLLEDTETPIDTTIMAKSEVFCVQPEKGGRKPARFIVFPDLGVRVCEKMALYDVVSTLPQAVMGSSYGFQYSPKQRVEFLVNTWKSKKCPMGFSYDTRCFDSTVTENDIRVEESIYQCCDLAPEARQAIKSLTERLYIGGPLTNSKGQSCGYRRCRASVVLTTSCGNTLTCYLKASAACRAAKLQDCTMLVNGDDLVVICESAGTQEDAASLRVFTEAMTRYSAPPGDPPKPEYDLELITSCSSNVSVAHDASGKRVYYLTRDPETPLARAAWETAKHTPVNSWLGNIIMYAPTLWARMILMTHFFSILLAQEQLEKALDCQIYGACYSIEPLDLPQIIERLHGLSAFSLHSYSPGEINRVASCLRKLGVPPLRAWRHRARSVRAKLLSQGGRAANCGKYLFNWAVKTKLKLTPIPAASQLDLSSWFVAGYSGGDIYHSLSRARPRWFMLCLLLLSVGVGIYLLPNR

SEQ ID NO: 53 - protein, 3011 aa, Artificial Sequence
  Recombinant polypeptide
MSTNPKPQRKTKRNTNRRPMDVKFPGGGQIVGGVYVLPRRGPRLGVRAARKTSERSQPRGRRQPIPKARQPEGRAWAQPGYPWPLYANEGLGWAGWLLSPRGSRPHWGPNDPRRRSRNLGKVIDTITCGFADLMGYIPLVGAPLGGAARALAHGVRVLEDGVNYATGNLPGCSFSVFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQGCNCSIYPGHITGHRMAWDMMMNWSPTAALVVAQLLRIPQAILDMIAGAHWGVLAGIAYFSMVGNWAKVLVVLLLFAGVDAETHVTGGSAGHTTAGLVRLLSPGAKQNIQLINTNGSWHINRTALNCNESLNTGWLAGLFYHHKFNSSGCPERLASCRPLADFAQGWGPISYANGSGPDQRPYCWHYPPRPCGIVPAKSVCGPVYCFTPSPVVVGTTDRSGAPTYNWGENDTDVFVLNNTRPPLGNWFGCTWMNSTGFTKVCGAPPCVIGGVGNNTLHCPTDCFRKHPEATYSRCGSGPWITPRCLVHYPYRLWHYPCTVNYTLFKVRMYVGGVEHRLEAACNWTRGERCDLDDRDRSELSPLLLSTTQWQVLPCSFTTLPALTTGLIHLHQGIVDVQYLYGVGSSIASWAIKWEYVVLLFLLLADARVCSCLWMMLLISQVEAALENLVVLNAASLAGTHGLVSFLVFFCFAWYLKGRWVPGAAYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGQEILLGPADGMVSKGWRLLAPITAYTQQTRGLLGCIITSLTGRDKNQVEGEVQIVSTAAQTFLATCINGVCWTVYHGAGTRTIASPKGPVIQMYTNVDKDLVGWPAPQGARSLTPCACGSSDLYLITRQADVIPARRRGDSRAALLSPRPISTLKGSSGGPLLCPAGHAVGIFRAAVCTRGVAKAVDFIPVENLETTMRSPVYTDNSSPPAVPQSFQVAHLHAPTGSGKSTKVPAAYASQGYKVLVLNPSVAATLSFGAYMSKAHGIDPNIRTGVRTITTGSPITYSTYGKFLADGGCSAGAYDIIICDECHSTDATSILGIGTVLDQAETAGARLVVLAAATPPGSVTVPHSNIEEVALSTTGEIPFYGKAIPLEVIKGGRHLIFCHSKKKCDELAAKLVALGINAVAYYRGLDVSVIPASGDVVVVATDALMTGYTGDFDSVIDCNTSVIQTVDFSLDPTFTIETTTLPQDAVSRTQRRGRTGRGKPGIYRFVAPGERPSGMFDSSILCECYDAGCAWYELTPAETTVRLRAYMNTPGLPVCQDHLEFWEGVFTGLTRIDAHFLSQTKQSGENLPYLVAYQATVCARARAPPPSWDSMWKCLIRLKPMLTGPTPLLYRLGAVQNEITLTHPVTKYIMTCMAADLEVVTSTWVMVGGLLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILTGYGAGVAGALVAFKIMSGEVPSTEDLVNLLPAILSPGALVVGVICAGILRRHVGPGEGAVQWMNRLIAFASRGNHVSPAHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEVGGNITRVESENKVIVLDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEAGTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSARSKFGYGAKDVRCHARKAVNHINSVWKDLLEDSVTPIDTTIMAKNEVFCVDPAKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVIAESDGVEEDNRALRAFTEAMTRYSAPPGDPPQPEYDLELITSCSSNVSVAHDGAGKRVYYLTRDPTTPLARAAWETARHTPINSWLGNIIMFAPTLWARMILMTHFFSVLIARDQLEQALDCEIYGACYSIEPLDLPPIIQRLHGLSAFSLHGYSPVELNRVGACLRKLGVPPLRAWRHRARNVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 54 - protein, 3010 aa, Artificial Sequence
  Recombinant polypeptide
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVALTPTLAARNSSIPTTTIRRHVDLLVGAAAFCSAMYVGDLCGSVFLVSQLFTFSPRRHWTTQDCNCSIYPGHITGHRMAWDMMMNWSPTTALVVSQLLRIPQAVVDMVAGAHWGVLAGLAYYSMVGNWAKVLVVLLLFAGVDAETRVTGGAAGHTAFGFASFLAPGAKQKIQLINTNGSWHINRTALNCNDSLNTGFLAALFYVHKFNSSGCPERLASCRPLADFDQGWGPISYANGSGPDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCACLWMMLLIAQAEAALENLVVLNAASVAGAHGILSFLVFFCAAWYIKGRLVPGAAYALYGVWPLLLLLLALPPRAYAMDREMAASCGGVVLVGLMALTLSPYYKRYISWCLWWLQYFLTRVEAQLHVWVPPLNVRGGRDAIILLTCVVHPTLVFDITKLLLAVFGPLWILQASLLKVPYFVRAQGLIRACMLVRKVAGGHYVQMAIIKLGALTGTYVYNHLTPLRDWAHNGLRDLAVAVEPVVFSDMETKIITWGADTAACGDIINGLPVSARRGREILLGPADGMVSKGWRLLAPITAYAQQTRGLLGCIITSLTGRDKNQVEGEVQVVSTATQSFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSSGGPLLCPAGHAVGIFRAAVCTRGVAKAVDFIPVESMETTMRSPVFTDNSSPPAVPQTFQVAHLHAPTGSGKSTKVPAAYAAQGYKVLVLNPSVAATLGFGAYMSKAHGIDPNIRTGVRTITTGAPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETTTVPQDAVSRSQRRGRTGRGKPGIYRFVTPGERPSGMFDSSVLCECYDAGCAWYELTPAETTVRLRAYLNTPGLPVCQDHLEFWEGVFTGLTHIDAHFLSQTKQAGDNFPYLVAYQATVCARAQAPPPSWDQMWKCLIRLKPTLHGPTPLLYRLGAVQNEVTLTHPITKYIMTCMSADLEVVTSTWVLVGGVLAALAAYCLTTGSVVIVGRIVLSGKPAIIPDREVLYREFDEMEECASHLPYIEQGMQLAEQFKQKALGLLQTATKQAEAAAPVVESKWRALEAFWAKHMWNFISGIQYLAGLSTLPGNPAIASLMAFTAAVTSPLTTSQTLLFNILGGWVAAQLAPPSAASAFVGAGIAGAAVGSIGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIMHTRCHCGAEITGHVKNGSMRIVGPKTCSNTWHGTFPINAYTTGPCTPSPAPNYSRALWRVAAEEYVEVTRVGDFHYVTGMTTDNLKCPCQVPSPEFFTELDGVRLHRFAPPCKPLLREEVSFRVGLHEYPVGSQLPCEPEPDVAVLTSMLTDPSHITAETAKRRLARGSPPSLASSSASQLSAPSLKATCTTHHDSPDADLIEANLLWRQEMGGNITRVESENKVVILDSFDPLVAEEDEREISVPAEILRKSRRFAPALPIWARPDYNPPLLESWKDPDYVPPVVHGCPLPPTKAPPIPPPRRKRTVVLTESTVSSALAELATKSFGSSSTSGITGDNTTTSSEPAPSGCPPDSDAESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSTLPQAVMGSSYGFQYSPGQRVEFLVQAWKSKKTPMGFSYDTRCFDSTVTESDIRTEEAIYQCCDLDPQARVAIKSLTERLYVGGPLTNSKGQNCGYRRCRASGVLTTSCGNTLTCYLKASAACRAAKLQDCTMLVCGDDLVVICESAGTQEDAASLRAFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPPIIQRLHGLSAFSLHSYSPGEINRVAACLRKLGVPPLRAWRHRARSVRAKLLSQGGRAATCGKYLFNWAVRTKLKLTPIPAASQLDLSGWFVAGYSGGDIYHSLSRARPRWFMLCLLLLSVGVGIYLLPNR

SEQ ID NO: 55 - protein, 3019 aa, Artificial Sequence
  Recombinant polypeptide
MSTLPKPQRKTKRNTNRRPMDVKFPGGGQIAGGVYLLPRRGPRLGVRAVRKTSERSQPRGRRQPIPKARQPQGRHWAQPGYPWPLYGNEGCGWPGWLLSPRGSRPHWGPNDPRRRSRNLGKVIDTITCGLADLMGYIPVVGAPLGGVAAALAHGVRAIEDGINYATGNLPGCSFSIFILALLSCLTTPASALTYGNSSGLYHLTNDCPNSSIVLEADAMILHLPGCLPCVRVDNRSTCWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTGGLVSIFSPGAKQNLQLINTNGSWHINRTALNCNDSLQTGFIASLFYTHKFNSSGCPERMAACKPLADFRQGWGQITYKVNISGPSDDRPYCWHYAPRPCDVVPARTVCGPVYCFTPSPVVVGTTDRRGNPTYTWGENETDVFMLESLRPPTGGWFGCTWMNSTGFTKTCGAPPCQIVPGDYNSSANELLCPTDCFRKHPEATYQRCGSGPWVTPRCLVDYPYRLWHYPCTVNFTLHKVRMFVGGIEHRFDAACNWTRGERCELHDRDRIEMSPLLFSTTQLAILPCSFSTMPALSTGLIHLHQNVVDVQYLYGVSSSVTSWVVKWEYIVLMFLVLADARICTCLWLMLLISNVEAAVERLVVLNAASAAGTAGWWWAVLFLCCVWYVKGRLVPACTYMALGMWPLLLTILALPPRAYAMDNEQAASLGAVGLLVITIFTITPMYKKLLTCFIWWNQYFLARAEAMVHEWVPDLRVRGGRDSIILLTCLLHPQLGFEVTKILLAILAPLYILQYSLLKVPYFVRAHILLRACLLVRRLAGGKYVQACLLRLGAWTGTFVYDHLAPLSDWASDGLRDLAVAVEPVIFSPMEKKVITWGADTAACGDILSGLPVSARLGNLVLLGPADDMQRGGWKLLAPITAYAQQTRGLVGTIVTSLTGRDKNEVEGEIQVVSTATQSFLATSINGVMWTVYHGAGSKTLAGPKGPVCQMYTNVDKDLVGWPSPPGARSLTPCACGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPNVRTGVRTVTTGGAITYSTYGKFLADGGCSGGAYDVIICDECHSTDPTTVLGIGTVLDQAETAGVRLTVLATATPPGSITVPHPNITETALPTTGEIPFYGKAIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTTVPQDAVARSQRRGRTGRGKPGVYRFVSQGERPSGMFDTVVLCEAYDTGCAWYELTPSETTVRLRAYMNTPGLPVCQDHLEFWEAVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVVAALAAYCLSVGCVVICGRITLTGKPAVVPDREILYQQFDEMEECSRHIPYLAEGQQIAEQFRQKVLGLLQASAKQAEELKPAVHSAWPKLEQFWQKHLWNFVSGIQYLAGLSTLPGNPAVASLMSFSASLTSPLSTSTTLLLNILGGWVASQLANPTASTAFVVSGLAGAAVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPTHITAETAARRLKRGSPPSLASSSASQLSAPSLKATCTTSKDHPDMELIEANLLWRQEMGSNITRVESENKVVVLDSFEPLTAEYDEREISVSAECHRPPRHKFPPALPIWARPDYNPPLLQAWQMPGYEPPVVSGCAVAPPKPAPIPPPRRKRLVHLDESTVSHALAQLADKVFVESSNDPGPSSDSGLSITSPVPPAPSTPDDACSEAESYSSMPPLEGEPGDPDLSSGSWSTVSDQDDVVCCSMSYSWTGALITPCAAEEEKLPINPLSNSLIRHHNMVYSTTSRSASLRQKKVTFDRVQVFDQHYQDVLKEIKLRASTVQAKLLSIEEACDLTPSHSARSKYGYGAQDVRSHASKAINHINSVWEDLLEDSDTPIPTTIMAKNEVFCVDPSKGGRKPARLIVYPDLGVRVCEKMALYDVTRKLPQAVMGSAYGFQYSPNQRVEYLLKMWRSKKVPMGFSYDTRCFDSTVTERDIRTENDIYQSCQLDPVARKAVSSLTERLYVGGPMVNSKGQSCGYRRCRASGVLPTSMGNTLTCYLKAQAACRAANIKDCDMLVCGDDLVVICESAGVQEDTASLRAFTDAMTRYSAPPGDAPQPTYDLELITSCSSNVSVAHDGNGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPGELNRVGACLRKLGAPPLRAWRHRARAVRAKLIAQGGKAAICGKYLFNWAVKTKLKLTPLVSASKLDLSGWFVAGYDGGDIYHSVSQARPRLLLLGLLLLTVGVGIFLLPAR

SEQ ID NO: 56 - protein, 3033 aa, Artificial Sequence
  Recombinant polypeptide
MSTNPKPQRITKRNINRRPQDVKFPGGGQIVGGVYLLPRRGPRLGVRTTRKTSERSQPRGRRQPIPKDRRSTGKSWGKPGYPWPLYGNEGLGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTNAVLHLPGCVPCENDNGTLRCWIQVTPNVAVKHRGALTHNLRTHVDMIVMAATVCSALYVGDVCGAVMIVSQALIVSPERHNFTQECNCSIYPGTITGHRMAWDMMLNWSPTLTMILAYAARVPELVLEVVFGGHWGVMFGLAYFSMQGAWAKVIAILLLVAGVDATTYSTGAQAGRGASGIANLFTPGAKQNIQLINTNGSWHINRTALNCNDSLKTGFIASLFYTHRFNSSGCPERLSSCRGLDDFRIGWGTLEYETNVTNDEDMRPYCWHYPPKPCGIVSARTVCGPVYCFTPSPVVVGTTDRQGVPTYSWGENETDVFLLNSTRPPRGAWFGCTWMNGTGFTKTCGAPPCRIRRDYNSTLDLLCPTDCFRKHPDATYLKCGAGPWLTPKCLVEYPYRLWHYPCTINYTIFKIRMYVGGVEHRLSAACNFTRGDRCRLEDRDRGQQSPLLHSTTEWAVLPCSFSDLPALSTGLLHLHQNIVDVQYMYGLSPALTKYIVRWEWVVLLFLLLADARVCACLWMLIILGQAEAALEKLIILHSASAASANGPLWFFIFFTAAWYLKGRVVPVATYSVLGLWSFLLLVLALPQQAYALDAAEQGELGLVILVIISIFTLTPAYKILLSRSVWWLSYMLVLAEAQIQQWVPPLEARGGRDGIIWVAVILHPRLVFEVTKWLLAILGSAYLLKASLLRVPYFVRAHALLRVCTLVRHLAGARYIQMLLITIGRWTGTYIYDHLSPLSTWAAQGLRDLAVAVEPIIFSPMEKKVIVWGAETVACGDILHGLPVSARLGREVLLGPADGYTSKGWKLLAPITAYTQQTRGLLGAIVVSMTGRDKTEQAGEIQVLSTVTQSFLGTSISGVLWTVYHGAGNKTLAGSRGPVTQMYSSAEGDLVGWPSPPGTKSLDPCTCGAVDLYLVTRNADVIPVRRKDDRRGALLSPRPLSTLKGSSGGPVLCPRGHAVGLFRAAVCSRGVAKSIDFIPVETLDIVTRSPTFSDNSTPPAVPQSYQVGYLHAPTGSGKSTKVPVAYAAQGYKVLVLNPSVAATLGFGAYLSKAHGINPNIRTGVRTVTTGDPITYSTYGKFIADGGCSAGAYDIIICDECHSVDATTILGIGTVLDQAETAGVRLVVLATATPPGTVTTPHSNIEEVALGHEGEIPFYGRAIPLSYIKGGRHLIFCHSRKKCDELAAALRGMGLNAVAYYRGLDVSVIPTQGDVVVVATDALMTGFTGDFDTVIDCNVAVTQIVDFSLDPTFTITTQTVPQDAVSRSQRRGRTGRGRLGIYRYVSTGERASGMFDSVVLCECYDAGAAWYELTPAETTVRLRAYFNTPGLPVCQDHLEFWEAVFTGLTHIDAHFLSQTKQSGENFAYLTAYQATVCARAKAPPPSWDVMWKCLTRLKPTLVGPTPLLYRLGSVTNEVTLTHPVTKYIATCMQADLEVMTSTWVLAGGVLAAVAAYCLATGCVSIIGRLHINQRAVVAPDKEVLYEAFDEMEECASKAALIEEGQRIAEMLKSKIQGLLQQASKQAQDIQPAVQASWPKVEQFWAKHMWNFHSGIPYLARLSQLPGNPAVASMMAFSAALTSPLSTSTTILLNIMGGWLASQIAPPAGATGFVVSGLVGAAVGSIGLGKILVDVLAGYGAGISGALVAFKIMSGEKPSVEDVVNLLPGILSPGALVVGVICAAILRRHVGQGEGAVQWMNRLIAFASRGNHVAPTHYVTESDASQRVTQLLGSLTITSLLRRLHNWITEDCPIPCAGSWLRDVWDWVCTILTDFKNWLTSKLFPKMPGLPFISCQKGYRGVWAGTGIMTTRCPCGANISGNVRLGSMRITGPKTCMNTWQGTFPINCYTEGPCVPKPPPNYKTAIWRVAASEYVEVTQHGSFSYVTGLTSDNLKVPCQLPSPEFFSWVDGVQIHRFAPTPKPFFRDEVSFCVGLNSFVVGSQLPCDPEPDTEVLASMLTDPSHITAEAAARRLARGSPPSEASSSASQLSAPSLRATCTTHGKTYDVDMVDANLFMGGDVTRIESESKVVVLDSLDSMTEVEDDREPSVPSEYLIRRRKFPPALPPWARPDYNPPVIETWKRPGYEPPTVLGCALPPTPQAPVPPPRRRRAKVLTQDNVEGVLREMADKVLSPLQDHNDSGHSTGADTGGDSVQQPSDETAASETGSLSSMPPLEGEPGDPDLEFEPARSAPPSEGECEVIDSDSKSWSTVSDQEDSVICCSMSYSWTGALITPCGPEEEKLPINPLSNSLLRYHNKVYCTTSKSASLRAKKVTFDRVQVLDAHYDSVLKDIKLAASKVSARLLTLEEACQLTPPHSARSKYGFGAKEVRSLSGRAVNHIKSVWKDLLEDSQTPIPTTIMAKNEVFCVDPTKGGKKAARLIVYPDLSVRVCEKMALYDVTQKLPQAVMGASYGFQYSPAQRVEFLLKAWAEKKDPMGFSYDTRCFDSTVTERDIRTEESIYQACSLPQEARTVIHSLTERLYVGGPMFNSKGQTCGYRRCRASGVFTTSMGNTMTCYIKALAACKAAGIVAPTMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLDAFSLHTYSPHELSRVAATLRKLGAPPLRAWKSRARAVRASLIAQGGRAAICGRYLFNWAVKTKLKLTPLPEARLLDLSSWFTVGAGGGDIYHSVSRARPRLLLLCLLLLSVGVGIFLLPAR

SEQ ID NO: 57 - protein, 3008 aa, Artificial Sequence
  Recombinant polypeptide
MSTNPKPQRKTQRNTNRRPTDVKFPGGGQIVGGVYLLPRRGPRLGVRATRKTSERSQPRGRRQPIPKARRSEGRSWAQPGYPWPLYGNEGCGWAGWLLSPRGSRPSWGPNDPRGRSRNLGKVIDTLTCGFADLMGYIPLVGAPVGSVARALAHGVRAVEDGINYATGNLPGCSFSIFLLALLSCLTVPASAINYRNTSGIYHVTNDCPNSSIVYEADHHILHLPGCVPCVREGNQSRCWVALTPTVAAPYIGAPLESLRSHVDLMVGAATVCSALYIGDLCGGLFLAGQMFSFRPRRHWTTQECNCSIYTGHITGHRMAWDMMMSWSPTTTLVLSQVMRIPSTLVDLLAGGHWGVLVGVAYFSMQANWAKVILVLFLFAGVDAETHVSGAAVGRSTAGLANLFSSGSKQNLQLINSNGSWHINRTSLNCNDSLNTGFLASLFYTHKFNSSGCSERLACCKSLDSYGQGWGPLGVANISGPSEDRPYCWHYPPRPCGIVPALSVCGPVYCFTPSPIVVGTTDRLGVPTYTWGENESDVFLLNSTRPPQGAWFGCVWMNSTGFTKACGAPPCEVNTNNGTWHCPTDCFRKHPETTYAKCGSGPWITPRCLIHYPYRLWHFPCTVNFTVFKVRTFIGGIEHRMEAACNWTRGEVCGLEHRDRAELSPLLLSTTTWQILPCSFTTLPALSTGLIHLHQNTVDVQYLYGVGSAVVSWALKWEYVVLAFLLLADARVSACLWMMFMVSQVEAALSNLININAASAAGNHGFWYAIFFICIAWHVKGRLPAAATYVACGMWPLLLLLLMLPERAYAFDREVAGSLGGAVVVALTILTLSPHYKSWLAKGLWWIQYFIARAEALLHVYVPSFDVRGPRDSLIILAVLACPHLTFDITKHLLAILGPLYILQASLLRIPYFVRAHALIKICSLLRGVVHGKYCQMVVLKMGALTGTYIYDHLTPLSDWAAEGLRDLAVALEPVVFTAMEKKVIVWGADTAACGDIIRGLPVSARLGNEILLGPADSETSKGWRLLAPITAYAQQTRGLFSTIITSLTGRDTNENCGEVQVLSTATQSFLGTAVNGVMWSVYHGAGSKTISGPKGPVNQMYTNVDQDLVGWPAPPGVKSLTPCTCGASDLYLVTRHADVVPVRRRGDTRGALLSPRPISILKGSSGGPLLCPMGHAAGLFRAAVCTRGVAKAVDFVPVESLETTMRSPVFTDNSTPPAVPQTYQVAHLHAPTGSGKSTKVPAAHAAQGYKVLVLNPSVAATLGFGAYMSKAYGIDPNIRSGVRTITTGAPITYSTYGKFLADGGCAGGAYDIIICDECHSTDSTTILGIGTVLDQAETAGVRLTVLATATPPGSVTTPHSNIEEVALPTTGEVPFYGKAIPLELIKGGRHLIFCHSKKKCDELAKQLTSLGLNAVAYYRGLDVSVIPLSGDVVVCATDALMTGFTGDFDSVIDCNTSVIQTVDFSLDPTFSIEITTVPQDAVSRSQRRGRTGRGRLGIYRYVTPGERPSGIFDTSVICECYDAGCAWYELTPAETTTRLRAYFNTPGLPVCQDHLEFWESVFTGLTQIDGHFLSQTKQSGENFPYLVAYQATVCARALAPPPSWDTMWKCLLRLKPTLRGPTPLLYRLGSVQNEVTLTHPITKYIMACMSADLEVVTSTWVMVGGLLAALAAYCLSVGSVVIVGRVVLSGQPAVIPDREVLYQQFDEMEECSKHLPLVEHGLQLAEQFKQKAVGLLNFAGKQAQEATPVIQSNFAKLEQFWAKHMWNFISGIQYLAGLSTLPGNPAIASLMSFTAAVTSPLTTQQTLLFNILGGWVASQIATPTASTAFVISGIAGAAVGSVGLGKILVDILAGYGAGVAGAVVTFKIMSGEMPSTEDLVNLLPAILSPGALVVEVVCPAILRRHVGPGEGAVQWMNRLIAFASRGNHVAPTHYVPESDAARRVTTILSSLTVTSLLRRLHKWINEDCSTPCAESWLWEVWDWVCTVLSDFKTWLKAKLLPLMPGIPFLSCQRGYRGEWRGDGVMHTTCPCGAELAGHIKNGSMRITGPKTCSNTWHGTFPINAYTTGPGVPVPAPNYKFALWRVSAEEYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAESARRRLARGSRPSLASSSASQLSPRLLQATCTAPHDSPGTDLLEANLLWGSTATRVETDEKVIILDSFEPRVAESDDDREVSVAAEILRPTKKFPPALPIWARPDYNPPLTETWKQQDYKPPTVHGCALPPSKQPPVPPPRRKRTVQLTESVVSTALAELAAKTFGQSELGSDSGADLTTPTETTDSGPILVDDASDDGSYSSMPPLEGEPGDPDLTSDSWSTVSGSEDVVCCSMSYSWTGALVTPCAAEESKLPISPLSNSLLRHHNMVYATTTRSAVTRQKKVTFDRLQVVDNHYNETLKEIKARASRVKARLLTTEEACDLTPPHSARSKFGYGAKDVRSHSRKAINHINSVWEDLLEDNNTPIPTTIMAKNEVFAVNPAKGGRKPARLIVYPDLGVRVCEKRALHDVINQLPKAVMGAAYGFQYSPAQRVEFLLTSWKSKKTPMGFSYDTRCFDSTVTEKDIRTEEEVYQCCDLEPEARKVIAALTERLYVGGPMHNSKGDLCGYRRCRASGVYTTSFGNTLTCYLKATAAIKAAGLRDCTMLVCGDDLVVIAESDGVEEDNRALRAFTEAMTRYSAPPGDAPQPAYDLELITSCSSNVSVAHDATGKKVYYLTRDPETPLARAAWETVRHTPVNSWLGNIIVYAPTIWVRMILMTHFFSILQSQEALEKALDFDMYGVTYSITPLDLPAIIQRLHGLSAFTLHGYSPHELNRVAGSLRKLGVPPLRAWRHRARAVRAKLIAQGGRAKICGIYLFNWAVKTKLKLTPLPAAAKLDLSGWFTVGAGGGDIYHSMSHARPRYLLLCLLLLSVGVGIFLLPAR

SEQ ID NO: 58 - protein, 3022 aa, Artificial Sequence
  Recombinant polypeptide
MSTLPKPKRQTKRNTLRRPKNVKFPAGGQIVGEVYVLPRRGPKLGVRATRKNSERSQPRGRRQPIPKARRPTGRSWGQPGYPWPLYANEGLGWAGWLLSPRSSRPNWGPNDPRRKSPNLGRVIHTLTCGFPHLMGYIPLVGGPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMKWSPTTALLMAQLLRIPQVVIDIIAGAHWGILAGLAYYSMQGNWAKVAIIMVMFSGVDAHTYTTGGTASRHTQAFAGLFDIGPQQKLQLVNTNGSWHINSTALNCNESINTGFIAGLFYYHKFNSTGCPQRLSSCKPITFFKQGWGPLTDANITGPSDDKPYCWHYPPRPCNITKPLNVCGPVYCFTPSPVVVGTTDIKGLPTYRFGVNESDVFLLTSLRPPQGRWFGCVWMNSTGFVKTCGAPPCNIYGGMKDIEANQTHLKCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDTQYLYGLSSSIVSWAVKWEYIMLVFLLLADARVCVALWLMLMISQAEAALENLVTLNAVAAAGTHGIGWYLVAFCAAWYVRGKLVPLVTYSLTGLWSLALLVLLLPQRAYAWSGEDSATLGAGVLVLFGFFTLSPWYKHWIGRLIWWNQYTICRCESALQVWVPPLLARGSRDGVILLTSLLYPSLIFDITKLLIAVLGPLYLIQAALTSTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGRELLLGPADDYREMGWRLLAPITAHAQQTRGLFGTIVTSLTGRDKNVVTGEVQVLSTATQTFLGTTVGGVMWTVYHGAGSRTLAGAKHPALQMYTNVDQDLVGWPAPPGAKSLEPCACGSADLYLVTRDADVIPARRRGDSTASLLSPRPLACLKGSSGGPVMCPSGHVAGIFRAAVCTRGVAKALQFIPVETLSTQARSPSFSDNSTPPAVPHEFQVGHLHAPTGSGKSTKVPAAYVAQGYNVLVLNPSVAATLGFGSFMSRAYGIDPNIRTGNRTVTTGAKLTYSTYGKFFADGGCSGGAYDVIICDECHAQDATSILGIGTVLDQAETAGVRLTVLATRTPPGSITVPHSNIEEVALGSEGEIPFYGKAIPIALLKGGRHLIFCHSKKKCDEIASKLRGMGLNAVAYYRGLDVAVIPATGDVVVCSTDALMTGFTGDFDSVIDCNVAVEQYVDFSLDPTFSIETRTAPQDAVSRSQRRGRTGRGRHGIYRYVSSGERPSGIFDSVVLCECYDAGCSWYDLQPAETTVRLRAYLSTPGLPVCQDHLDFWESVFTGLTHIDAHFLSQTKQQGLNFSYLTAYQATVCARAKASPPCWDEMWKCLVRLKPTLHGPTPLLYRLGPVQNETCLTHPITKYVMACMSADLEVTTSTWVLLGGVLAALAAYCLSVGCVVIVGHIELGGKPALVPDKEVLYQQYDEMEECSQAAPYIEQAQAIAHQFKEKVLGLLQRATQQQAVIEPIVATNWQKLEAFWHKHMWNFVSGIQYLAGLPTLPGNPAVASLMAFTASVTSPLTTNQTMFFNILGGWVATHLAGPQSSSAFVVSGLAGAAIGGIGLGRVLLDILAGYGAGVSGALVAFKIMCGERPTAEELVNLLPSILCPGALVVGVICAAVLRRHIGPGEGAVQWMNRLIAFASRGNHGSPTHYVPESDAAAKVTALLSSLTVTRLLRRLHQWINEDYPSPCSDDWLRIIWDWVCSVLADFKTWLSAKIMPALPGLPFISCQKGYKGVWRGDGVMSTRCPCGATITGHVKNGSMRLAGPRTCANMWHGTFPINEYTTGPSTPCPSPNYTRALWRVAANSYVEVRRVGDFHYITGATEDELKCPCQVPAAEFFTEVDGVRLHRYAPPCKPLLRDDITFMVGLNSYAIGSQLPCEPEPDVTVLTSMLSDPAHITAETAKRRLNRGSPPSLANSSASQLSAPSLKATCQTHRPHPDAELVDANLLWRQEMGSNITRVESETKVVILDSFEPLRAETDDAELSVAAECFKKPPKYPPALPIWARPDYNPPLLDRWKAPDYVPPTVHGCALPPRGAPPVPPPRRKRTIQLDGSNVSAALAALAEKSFPSSKPQEENSSSSGVDTQSSTTSKVPPSPGGESDSESCSSMPPLEGEPGDPDLSCDSWSTVSDSEEQSVVCCSMSYSWTGALITPCSAEEEKLPISPLSNSLLRHHNLVYSTSSRSASQRQRKVTFDRLQVLDDHYKTALKEVKERASRVKARMLTIEEACALVPPHSARSKFGYSAKDVRSLSSRAINQIRSVWEDLLEDTTTPIPTTIMAKNEVFAVEPSKGGKKPARLIVYPDLGVRVCEKRALYDVIQKLSIATMGPAYGFQYSPQQRVERLLKMWTSKKTPLGFSYDTRCFDSTVTEQDIRVEEEIYQCCNLEPEARKVISSLTERLYCGGPMYNSKGQQCGYRRCRASGVLPTSFGNTITCYIKATAAAKAAGLRNPDFLVCGDDLVAICESQGTHEDEASLRAFTEAMTRYSAPPGDPPVPAYDLELVTSCSSNVSVARDDKGRRYYYLTRDATTPLARAAWETAKHSPVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAGRAKLIAQGGKAKICGLYLFNWAVRTKTKLTPLPTAGQLDLSSWFTVGVGGNDIYHSVSRARTRHLLLCLLLLTVGVGIFLLPAR

What is claimed is:

1. A multivalent HCV mosaic polypeptide composition comprising a set of polypeptides selected from the group consisting of the polypeptides of SEQ ID NOS: 42-44 and the polypeptides of SEQ ID NOS: 45-48.

2. The composition according to claim 1, wherein one or more of the selected polypeptides are fragmented to present individual HCV proteins.

3. The composition according claim 1, further comprising a pharmaceutically acceptable carrier.

4. The composition according to claim 1, further comprising an adjuvant.

5. The composition according to claim 1, further comprising a co-stimulatory molecule.

* * * * *